US011141474B2

(12) United States Patent
Rauch et al.

(10) Patent No.: US 11,141,474 B2

(45) Date of Patent: Oct. 12, 2021

(54) ARTIFICIAL NUCLEIC ACID MOLECULES ENCODING A NOROVIRUS ANTIGEN AND USES THEREOF

(71) Applicant: CureVac AG, Tübingen (DE)

(72) Inventors: Susanne Rauch, Tübingen (DE); Kim Ellen Schwendt, Dettenhausen (DE); Benjamin Petsch, Tübingen (DE)

(73) Assignee: CureVac AG, Tübingen (DE)

( * ) Notice: Subject to any disclaimer, the term of this patent is extended or adjusted under 35 U.S.C. 154(b) by 93 days.

(21) Appl. No.: 16/098,840

(22) PCT Filed: May 4, 2017

(86) PCT No.: PCT/EP2017/060673

§ 371 (c)(1),
(2) Date: Nov. 2, 2018

(87) PCT Pub. No.: WO2017/191264

PCT Pub. Date: Nov. 9, 2017

(65) Prior Publication Data

US 2019/0125857 A1 May 2, 2019

(30) Foreign Application Priority Data

May 4, 2016 (WO) ................. PCT/EP2016/060115

(51) Int. Cl.
*A61K 39/125* (2006.01)
*A61K 9/00* (2006.01)
(Continued)

(52) U.S. Cl.
CPC .......... *A61K 39/125* (2013.01); *A61K 9/0019* (2013.01); *A61P 31/12* (2018.01);
(Continued)

(58) Field of Classification Search
None
See application file for complete search history.

(56) References Cited

U.S. PATENT DOCUMENTS

2005/0032730 A1 2/2005 von der Mülbe et al.
2005/0059624 A1 3/2005 Hoerr et al.
(Continued)

FOREIGN PATENT DOCUMENTS

WO WO 2011/005799 1/2011
WO WO 2012/006377 1/2012
(Continued)

OTHER PUBLICATIONS

Smertina et al. (Frontiers in Microbiology. Jun. 2019; 10: 1280).*
(Continued)

*Primary Examiner* — Shanon A. Foley
(74) *Attorney, Agent, or Firm* — Parker Highlander PLLC

(57) ABSTRACT

The present invention is directed to an artificial nucleic acid and to polypeptides suitable for use in treatment or prophylaxis of an infection with Norovirus or a disorder related to such an infection. In particular, the present invention concerns a Norovirus vaccine. The present invention is directed to an artificial nucleic acid, polypeptides, compositions and vaccines comprising the artificial nucleic acid or the polypeptides. The invention further concerns a method of treating or preventing a disorder or a disease, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

16 Claims, 5 Drawing Sheets

Specification includes a Sequence Listing.

(51) Int. Cl.
*A61P 31/12* (2006.01)
*C07K 14/005* (2006.01)
*A61K 39/00* (2006.01)

(52) U.S. Cl.
CPC .... *C07K 14/005* (2013.01); *A61K 2039/5258* (2013.01); *A61K 2039/53* (2013.01); *C12N 2770/16034* (2013.01)

(56) References Cited

U.S. PATENT DOCUMENTS

2005/0250723 A1 11/2005 Hoerr et al.
2006/0188490 A1 8/2006 Hoerr et al.
2008/0025944 A1 1/2008 Hoerr et al.
2008/0267873 A1 10/2008 Hoerr et al.
2009/0324584 A1 12/2009 Hoerr et al.
2010/0048883 A1 2/2010 Ketterer et al.
2010/0189729 A1 7/2010 Hoerr et al.
2010/0203076 A1 8/2010 Fotin-Mleczek et al.
2010/0291156 A1 11/2010 Barner et al.
2010/0305196 A1 12/2010 Probst et al.
2011/0053829 A1 3/2011 Baumhof et al.
2011/0250225 A1 10/2011 Fotin-Mleczek et al.
2012/0021043 A1 1/2012 Kramps et al.
2012/0258046 A1 10/2012 Mutzke
2013/0129754 A1 5/2013 Thess et al.
2013/0142818 A1 6/2013 Baumhof et al.
2013/0259879 A1 10/2013 Baumhof et al.
2013/0280283 A1 10/2013 Lorenz et al.
2013/0295043 A1 11/2013 Kallen et al.
2013/0336998 A1 12/2013 Kallen et al.
2015/0037326 A1 2/2015 Butler-Ransohoff et al.
2015/0050302 A1 2/2015 Thess
2015/0057340 A1 2/2015 Thess et al.
2015/0093413 A1 4/2015 Thess et al.
2015/0118183 A1 4/2015 Baumhof
2015/0118264 A1 4/2015 Baumhof et al.
2015/0165006 A1 6/2015 Thess et al.
2015/0184195 A1 7/2015 Thess et al.
2015/0218554 A1 8/2015 Thess
2015/0306249 A1 10/2015 Baumhof et al.
2015/0320847 A1 11/2015 Thess et al.
2016/0130345 A1 5/2016 Fotin-Mleczek et al.
2016/0166668 A1 6/2016 Kallen et al.
2016/0166678 A1 6/2016 Kallen et al.
2016/0166710 A1 6/2016 Baumhof
2016/0166711 A1 6/2016 Schnee et al.
2016/0168207 A1 6/2016 Kramps et al.
2016/0168227 A1 6/2016 Kallen et al.
2016/0235864 A1 8/2016 Schlake et al.
2016/0304883 A1 10/2016 Grund et al.
2016/0304938 A1 10/2016 Wochner
2016/0326575 A1 11/2016 von der Mülbe
2016/0331844 A1 11/2016 Fotin-Mleczek et al.
2017/0014496 A1 1/2017 Fotin-Mleczek et al.
2017/0029847 A1 2/2017 Thess
2017/0114378 A1 4/2017 Wochner et al.
2017/0252430 A1 9/2017 Fotin-Mleczek et al.
2017/0326225 A1 11/2017 Rauch et al.
2018/0044687 A1 2/2018 Thess et al.
2018/0125952 A1 5/2018 Fotin-Mleczek et al.
2018/0126003 A1 5/2018 Hoerr
2018/0142275 A1 5/2018 Roos et al.
2018/0147146 A1 5/2018 Eber et al.
2018/0148727 A1 5/2018 Grund et al.
2018/0201967 A1 7/2018 Eber et al.
2018/0208957 A1 7/2018 Roos et al.
2018/0214537 A1 8/2018 Mutzke et al.
2018/0237786 A1 8/2018 Schlake et al.
2018/0237817 A1 8/2018 Roos et al.
2018/0243219 A1 8/2018 Ketterer et al.
2018/0296663 A1 10/2018 Hipp et al.
2018/0298372 A1 10/2018 Funkner et al.
2018/0312545 A1 11/2018 Baumhof et al.
2018/0371392 A1 12/2018 Mayer et al.
2019/0010485 A1 1/2019 Yazdan Panah et al.
2019/0017100 A1 1/2019 Wochner et al.
2019/0024096 A1 1/2019 Schmid et al.
2019/0125857 A1* 5/2019 Rauch .................. A61K 39/125

FOREIGN PATENT DOCUMENTS

WO WO 2013/120628 * 8/2013
WO WO 2015/024668 * 2/2015
WO WO 2016/184576 11/2016
WO WO 2017/021546 2/2017
WO WO 2017/025447 2/2017
WO WO 2017/064146 4/2017
WO WO 2017/081110 5/2017
WO WO 2017/109134 6/2017
WO WO 2017/137095 8/2017
WO WO 2017/140345 8/2017
WO WO 2017/140905 8/2017
WO WO 2017/149139 9/2017
WO WO 2017/162297 9/2017
WO WO 2017/182634 10/2017
WO WO 2017/186928 11/2017
WO WO 2017/191258 11/2017
WO WO 2017/191274 11/2017
WO WO 2017/203008 11/2017
WO WO 2017/212006 12/2017
WO WO 2017/212007 12/2017
WO WO 2017/212009 12/2017
WO WO 2019/008001 1/2019

OTHER PUBLICATIONS

LoBue et al., "Multivalent norovirus vaccine induce strong mucosal and systemic blocking antibodies against multiple strains", *Vaccine*, 24(24):5220-5234, 2006.
Office Communication issued in corresponding European Application No. 17725524, dated Dec. 5, 2019.
Parra et al., "Immunogenicity and specificity of norovirus Consensus GII.4 virus-like particles in monovalent and bivalent vaccine formulations", *Vaccine*, 30(24):3580-3586, 2012.
Bailey et al., "Functional Analysis of RNA Structures Present at the 3' Extremity of the Murine Norovirus Genome: the Variable Polypyrimidine Tract Plays a Role in Viral Virulence", *J. Virol.*, 84(6):2859-2870, 2010.
Database EMBL, Accession No. EU366113, Jan. 16, 2008.
Harrington et al., "Systemic, Mucosal, and Heterotypic Immune Induction in Mice Inoculated with Venezuelan Equine Encephalitis Replicons Expressing Norwalk Virus-Like Particles", *J. Virol.*, 76(2):730-742, 2002.
International Search Report and Written Opinion issued in corresponding PCT Application No. PCT/EP2017/060673, dated Sep. 13, 2017.
Ljungberg and Liljeström, "Self-replicating alphavirus RNA vaccines", *Expert Rev. Vacc.*, 14(2):177-194, 2015.

* cited by examiner

ARTIFICIAL NUCLEIC ACID MOLECULES ENCODING A NOROVIRUS ANTIGEN AND USES THEREOF

This application is a national phase application under 35 U.S.C. § 371 of International Application No. PCT/EP2017/060673, filed May 4, 2017, which claims benefit of International Application No. PCT/EP2016/060115, filed May 4, 2016, the entire contents of each of which are hereby incorporated by reference.

INTRODUCTION

The present invention is directed to an artificial nucleic acid and to polypeptides suitable for use in treatment or prophylaxis of an infection with Norovirus or a disorder related to such an infection. In particular, the present invention concerns a Norovirus vaccine. The present invention is directed to an artificial nucleic acid, polypeptides, compositions and vaccines comprising the artificial nucleic acid or the polypeptides. The invention further concerns a method of treating or preventing a disorder or a disease, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

Noroviruses (also known as Norwalk-like viruses or Norwalk viruses) are positive sense, single-stranded RNA Calciviruses (Sarvestani, Soroush T., et al. "Norovirus Infection: Replication, Manipulation of Host, and Interaction with the Host Immune Response." Journal of Interferon 6 Cytokine Research 36.4 (2016):215-225), containing a non-segmented RNA genome. The virus genome is organized in three open reading frames, of which the 5' proximal ORF encodes a large polyprotein that is cleaved into non-structural proteins; the minor capsid protein VP2 is encoded by ORF3 and the major capsid protein VP1 is encoded by ORF2 (Karst et al., Cell Host Microbe 11; 15(6):668-80, 2014; Robilotti E, Deresinski S, Pinsky B A. 2015. Norovirus. Clin Microbiol Rev 28:134-164).

Noroviruses are classified into five genogroups (GI-GV), and are further subdivided into genotypes based on the capsid sequence (Zheng, Du-Ping, et al. "Norovirus classification and proposed strain nomenclature." Virology 346.2 (2001):312-323; Kroneman, A., et al. "An automated genotyping tool for enteroviruses and noroviruses." Journal of Clinical Virology 51.2 (2011):121-125). Mostly viruses of genogroups I, II are known to infect humans (Ramani, Sasirekha, Robert L. Atmar, and Mary K. Estes. "Epidemiology of human noroviruses and updates on vaccine development.", Current opinion in gastroenterology 30.1 (2014): 25). Norwalk viruses (NV) genotype GI.1 was the first isolated Norovirus, however genotype GII.4 Noroviruses are currently the most frequently detected in humans (Glass, Roger I., Umesh D. Parashar, and Mary K. Estes. "Norovirus gastroenteritis." New England Journal of Medicine 361.18 (2009):1776-1785).

Infections with Noroviruses are generally self-limiting in healthy adults, displaying typical symptoms including non-bloody diarrhea, vomiting, nausea and abdominal cramps. However, in individuals with weakened immune system, including young children and elderly, infection can be severe and even fatal (Glass, Roger I., Umesh D. Parashar, and Mary K. Estes. "Norovirus gastroenteritis." New England Journal of Medicine 361.18 (2009):1776-1785). Nongastrointestinal-related illness, including neurodevelopmental disorders have also been reported after Norovirus infection. (Sarvestani, Soroush T., et al. "Norovirus Infection: Replication, Manipulation of Host, and Interaction with the Host Immune Response." Journal of Interferon C Cytokine Research 36.4 (2016):215-225).

Due to the low infectious dose, resistance to many common sterilization procedures, and ease of transmission, epidemic outbreaks are common and difficult to control (Glass, Roger I., Umesh D. Parashar, and Mary K. Estes. "Norovirus gastroenteritis." New England Journal of Medicine 361.18 (200B):1776-1785; Hutson et al., 2004). NoV has been shown to be the cause of the majority of nonbacterial gastroenteritis epidemics, resulting in a huge economic burden. In the US, the cost of NoV-associated hospitalizations has been estimated at approximately $500 million, while foodborne NoV cost due to healthcare and lost productivity has been estimated at $2 billion (Batz, Michael B., Sandra Hoffmann, and J. Glenn Morris Jr. "Ranking the disease burden of 14 pathogens in food sources in the United States using attribution data from outbreak investigations and expert elicitation." Journal of Food Protection 75.7 (2012):1278-1291). The rapid evolution of Norovirus genotypes through antigenic drift and changing glycan specificities still provide challenges in the development of potent vaccines (Ramani, Sasirekha, Robert L. Atmar, and Mary K. Estes. "Epidemiology of human noroviruses and updates on vaccine development." Current opinion in gastroenterology 30.1 (2014):25).

At present, there is no specific treatment of Norovirus infections. Therapy is limited to curing the symptoms caused by the infection. In addition, there is currently no vaccine available against Norovirus infections. There is therefore a strong need for a vaccine against Norovirus infection.

The underlying object of the present invention is therefore to provide a Norovirus vaccine. It is a further preferred object of the invention to provide a Norovirus vaccine, which may be produced at an industrial scale. A further object of the present invention is the provision of a storage-stable Norovirus vaccine. Further object of the underlying invention is to provide mRNA sequences coding for antigenic peptides or proteins derived from a protein of a Norovirus or a fragment or variant thereof for the use as a vaccine for prophylaxis or treatment of Norovirus infections. Furthermore, it is the object of the present invention to provide an effective Norovirus vaccine which can be stored without cold chain and which enables rapid and scalable vaccine production.

The object underlying the present invention is solved by the claimed subject-matter. Particularly, the objects underlying the present invention are solved according to a first aspect by an inventive by providing an artificial nucleic acid comprising at least one coding region encoding at least one polypeptide derived from a Norovirus, and/or a fragment or variant thereof.

Definitions

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid molecule, preferably an mRNA as defined herein. In this context, also fragments, variants and derivatives of peptides and proteins comprising at least one epitope are understood as antigens. In the context of the present invention, tumour antigens and pathogenic antigens as defined herein are particularly preferred.

Artificial nucleic acid molecule: An "artificial nucleic acid molecule" or "artificial nucleic acid" may typically be understood to be a nucleic acid molecule, e.g. a DNA or an RNA that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic nucleic acid or RNA and multicistronic nucleic acid or RNA: A bicistronic or multicistronic nucleic acid or RNA is typically a nucleic acid or an RNA, preferably an mRNA, that typically may have two (bicistronic) or more (multicistronic) coding regions. A coding region in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Complexation and Formulation: According to a preferred embodiment, the at least one mRNA of the inventive composition may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids. Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1:6:286). Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake: once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9:1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February: 66:110-116).

Therefore, in one embodiment the at least one mRNA of the inventive composition is complexed with cationic lipids and/or neutral lipids and thereby forms liposomes, lipid nanoparticles, lipoplexes or neutral lipid-based nanoliposomes.

Cationic component or cationic compound: The term "cationic component" or "cationic compound" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein which is positively charged under physiological conditions, particularly under physiological conditions in vivo. Further accordingly, a cationic peptide, protein, polysaccharide, lipid or polymer according to the present invention is positively charged under physiological conditions, particularly under physiological salt conditions of the cell in vivo. A "cationic peptide or protein" may contain at least one positively charged amino acid, or more than one positively charged amino acid, e.g. selected from Arg, His, Lys or Orn. Accordingly, "polycationic" components or compounds are also within the scope exhibiting more than one positive charge under the conditions given.

5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1.5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide. 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety.

Cap analogue: A cap analogue refers to a non-polymerizable di-nucleotide that has cap functionality in that it facilitates translation or localization, and/or prevents degradation of a nucleic acid molecule, particularly of an RNA molecule, when incorporated at the 5' end of the nucleic acid molecule. Non-polymerizable means that the cap analogue will be incorporated only at the 5'-terminus because it does not have a 5' triphosphate and therefore cannot be extended in the 3' direction by a template-dependent polymerase, particularly, by template-dependent RNA polymerase.

Cap analogues include, but are not limited to, a chemical structure selected from the group consisting of m7GpppG, m7GpppA, m7GpppC; unmethylated cap analogues (e.g., GpppG); dimethylated cap analogue (e.g., m2.7GpppG), trimethylated cap analogue (e.g., m2,2,7GpppG), dimethylated symmetrical cap analogues (e.g., m7Gpppm7G), or anti reverse cap analogues (e.g., ARCA: m7.2'OmeGpppG. m7.2'dGpppG, m7.3'OmeGpppG, m7.3'dGpppB and their tetraphosphate derivatives) (Stepinski et al., 2001. RNA 7(10):1486-95).

Further cap analogues have been described previously (U.S. Pat. No. 7,074,596, WO 2008/016473, WO 2008/157688, WO 2009/149253. WO 2011/015347, and WO 2013/059475). The synthesis of N7-(4-chlorophenoxyethyl) substituted dinucleotide cap analogues has been described recently (Kore et al. (2013) Bioorg. Med. Chem. 21(15): 4571-4).

5'-cap-Structure: A 5'-cap is typicallyα a modified nucleotide (cap analogue), particularly a guanine nucleotide, added to the 5' end of a nucleic acid molecule, particularly of an RNA molecule, e.g. an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide. 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3.5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanedial phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures may be used in the context of the present invention to modify the mRNA sequence of the inventive composition. Further modified 5'-cap structures which may be used in the context of the present invention are cap 1 (additional methylation of the ribose of the adjacent nucleotide of m77GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

In the context of the present invention, a 5' cap structure (cap0 or cap1) may also be formed in chemical RNA synthesis or RNA in vitro transcription (co-transcriptional capping) using cap analogues, or a cap structure may be formed in vitro using capping enzymes (e.g., commercially available capping kits). A cap structure (e.g., cap0 or cap1) may also be formed in vitro using immobilized capping enzymes, e.g. in a capping reactor as described in WO 2016/19322.

Chemical synthesis of nucleic acids: Chemical synthesis of relatively short fragments of oligonucleotides with defined chemical structure provides a rapid and inexpensive access to custom-made oligonucleotides of any desired sequence. Whereas enzymes synthesize DNA and RNA only in the 5' to 3' direction, chemical oligonucleotide synthesis does not have this limitation, although it is most often carried out in the opposite, i.e. the 3' to 5' direction. Currently, the process is implemented as solid-phase synthesis using the phosphoramidite method and phosphoramidite building blocks derived from protected nucleosides (A, C, G, and U), or chemically modified nucleosides.

To obtain the desired oligonucleotide, the building blocks are sequentially coupled to the growing oligonucleotide chain on a solid phase in the order required by the sequence of the product in a fully automated process. Upon the completion of the chain assembly, the product is released from the solid phase to the solution, deprotected, and collected. The occurrence of side reactions sets practical limits for the length of synthetic oligonucleotides (up to about 200 nucleotide residues), because the number of errors increases with the length of the oligonucleotide being synthesized. Products are often isolated by HPLC to obtain the desired oligonucleotides in high purity.

Chemically synthesized oligonucleotides find a variety of applications in molecular biology and medicine. They are most commonly used as antisense oligonucleotides, small interfering RNA, primers for DNA sequencing and amplification, probes for detecting complementary DNA or RNA via molecular hybridization, tools for the targeted introduction of mutations and restriction sites, and for the synthesis of artificial genes. Moreover, long-chain DNA molecules and long-chain RNA molecules may be chemically synthetized and used in the context of the present invention.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

Cloning site: A cloning site is typically understood to be a segment of a nucleic acid molecule, which is suitable for insertion of a nucleic acid sequence, e.g., a nucleic acid sequence comprising a coding region. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Coding region, coding sequence: A coding region, in the context of the invention, is typically a sequence of several nucleotide triplets, which may be translated into a peptide or protein. A coding region preferably contains a start codon, i.e. a combination of three subsequent nucleotides coding usually for the amino acid methionine (ATG), at its 5'-end and a subsequent region which usually exhibits a length which is a multiple of 3 nucleotides. A coding region is preferably terminated by a stop-codon (e.g., TAA, TAG, TGA). Typically, this is the only stop-codon of the coding region. Thus, a coding region in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding region may be isolated or it may be incorporated in a longer nucleic acid sequence, for example in a vector or an mRNA. In the context of the present invention, a coding region may also be termed "protein coding region", "coding sequence", "CDS", "open reading frame" or "ORF".

Derived from: The phrase "derived from" as used throughout the present specification in the context of a nucleic acid, i.e. for a nucleic acid "derived from" (another) nucleic acid, means that the nucleic acid, which is derived from (another) nucleic acid, shares at least 50%, preferably at least 60%, preferably at least 70%, more preferably at least 75%, more preferably at least 80%, more preferably at least 85%, even more preferably at least 90%, even more preferably at least 95%, and particularly preferably at least 98% sequence identity with the nucleic acid from which it is derived. In one embodiment, "derived from" means having in increasing order of preference at least 50%, 51%, 52%, 53%, 54%, 55%, 56%, 57%, 58%, 59%, 80%, 61%, 62%, 63%, 84%, 65%, 66%, 87%, 88%, 89%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 968%, 97%, 98%, or 99% or more sequence identity to the sequences as represented by SEQ ID NOs: 1-39690, 39713-39748. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the thymidines (T) by uracils (U) throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. It goes without saying that such modifications are preferred, which do not impair RNA stability, e.g. in comparison to the nucleic acid from which it is derived.

Different Noro virus: The term "different Noro virus" in the context of the invention has to be understood as the difference between at least two respective Noroviruses, wherein the difference is manifested on the RNA genome of the respective different virus. In the broadest sense, "different Norovirus" has to be understood as genetically "different Norovirus". Particularly, said (genetically) different Noroviruses express at least one different protein or peptide, wherein the at least one different protein or peptide preferably differs in at least one amino acid.

Same Norovirus: In the broadest sense, "same Norovirus" has to be understood as genetically the same. Particularly, said (genetically) same virus expresses the same proteins or peptides (e.g., at least one structural and/or non-structural protein), wherein all proteins or peptides have the same amino acid sequence.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate. deoxy-guanosine-monophosphate and deoxy-cytidine-monophosphate monomers which are—by themselves—composed of a sugar moiety (deoxyribose), a base moiety and a phosphate moiety, and polymerize by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Mono-, bi- and multicistronic and multi-antigen nucleic acids: A monocistronic nucleic acid may typically be a DNA or RNA, particularly an mRNA that comprises only one coding sequences. A coding sequence in this context is a sequence of several nucleotide triplets (codons) that can be translated into a peptide or protein According to a further embodiment the coding region of the at least one mRNA of the composition may encode at least two, three, four, five, six, seven, eight and more antigens (or fragments and derivatives thereof) linked with or without an amino acid linker sequence, wherein said linker sequence can comprise rigid linkers, flexible linkers, cleavable linkers (e.g., self-cleaving peptides) or a combination thereof. Therein, the antigens may be identical or different or a combination thereof. According to the present invention, specific antigen and/or epitope combinations according to the paragraph "specific antigen combinations" disclosed above are particularly envisioned. Particular antigen/epitope combinations can be encoded by said mRNA encoding at least two antigens as explained above (herein referred to as "multi-antigen-constructs/mRNA").

According to a further embodiment the composition of the present invention, may comprise a mixture of at least one monocistronic mRNA, as defined above, and/or at least one bicistronic mRNA as defined above, and/or at least one multicistronic mRNA, as defined above, and/or at least one multi-antigen-constructs as defined above, and any combinations thereof. According to the present invention, specific antigen combinations according to the paragraph "specific antigen combinations" disclosed above are particularly envisioned and may be generated using a combination of mono-, bi-, multicistronic mRNA and multi-antigen-constructs.

According to certain embodiments of the present invention, the mRNA sequence is mono-, bi-, or multicistronic, preferably as defined herein. The coding sequences in a bi- or multicistronic mRNA preferably encode distinct peptides or proteins as defined herein or a fragment or variant thereof. Preferably, the coding sequences encoding two or more peptides or proteins may be separated in the bi- or multicistronic mRNA by at least one IRES (internal ribosomal entry site) sequence, as defined below. Thus, the term "encoding two or more peptides or proteins" may mean, without being limited thereto, that the bi- or even multicistronic mRNA, may encode e.g. at least two, three, four, five, six or more (preferably different) peptides or proteins or their fragments or variants within the definitions provided herein. More preferably, without being limited thereto, the bi- or even multicistronic mRNA, may encode, for example, at least two, three, four, five, six or more (preferably different) peptides or proteins as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several peptides or proteins which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to a further embodiment the at least one coding region of the mRNA sequence according to the invention may encode at least two, three, four, five, six, seven, eight and more peptides or proteins (or fragments and derivatives thereof) as defined herein linked with or without an amino acid linker sequence, wherein said linker sequence can comprise rigid linkers, flexible linkers, cleavable linkers (e.g., self-cleaving peptides) or a combination thereof. Therein, the peptides or proteins may be identical or different or a combination thereof. Particular peptide or protein combinations can be encoded by said mRNA encoding at least two peptides or proteins as explained herein (also referred to herein as "multi-antigen-constructs/mRNA").

Epitope: (also called "antigen determinant") can be distinguished in T cell epitopes and B cell epitopes. T cell epitopes or parts of the proteins in the context of the present invention may comprise fragments preferably having a length of about B to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 5%, 10%, 20%, preferably at least 301%, more preferably at least 40%, more preferably at least 50%, even more preferably at least 31%, even more preferably at least 70%, and most preferably at least 801% of the total (i.e. full-length) molecule from which the fragment is derived.

G/C modified: A G/C-modified nucleic acid may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule: and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Genotype, genotype of a virus: The terms "genotype" or "genotype of a virus" have to be understood as the genetic constitution of an individual or a group or class of organisms having the same genetically consistent structure. Genotyping means determining differences in the genetic of an individual. In the context of the invention, Norovirus genotype has to be understood as a Noro virus having the same genetically consistent structure.

Heterologous sequence: Two sequences are typically understood to be "heterologous" if they are not derivable from the same gene or in the same allele. I.e., although heterologous sequences may be derivable from the same organism, they naturally (in nature) do not occur in the same nucleic acid molecule, such as in the same mRNA.

Homolog of a nucleic acid sequence: The term "homolog" of a nucleic acid sequence refers to sequences of other species than the particular sequence. It is particularly preferred that the nucleic acid sequence is of human origin and therefore it is preferred that the homolog is a homolog of a human nucleic acid sequence.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component which is able to induce an immune response is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have a coding region and thus does not provide a peptide-antigen or immunogen but elicits an immune response e.g. by binding to a specific kind of Toll-like-receptor (TLR) or other suitable receptors. However, of course also mRNAs having a coding region and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides. TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33. IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Jet injection: The term “jet injection”, as used herein, refers to a needle-free injection method, wherein a fluid containing at least one inventive nucleic acid sequence (e.g., RNA, DNA, mRNA) and, optionally, further suitable excipients is forced through an orifice, thus generating an ultra-fine liquid stream of high pressure that is capable of penetrating mammalian skin and, depending on the injection settings, subcutaneous tissue or muscle tissue. In principle, the liquid stream forms a hole in the skin, through which the liquid stream is pushed into the target tissue. Preferably, jet injection is used for intradermal, subcutaneous or intramuscular injection of the mRNA sequence according to the invention. In a preferred embodiment, jet injection is used for intramuscular injection of the mRNA sequence according to the invention. In a further preferred embodiment, jet injection is used for intradermal injection of the mRNA sequence according to the invention.

Monovalent/monovalent vaccine: A monovalent vaccine, also called univalent vaccine, is designed against a single antigen for a single organism. The term “monovalent vaccine” includes the immunization against a single valence. In the context of the invention, a monovalent Norovirus vaccine would comprise a vaccine comprising an artificial nucleic acid encoding one single antigenic peptide or protein derived from one specific Norovirus strain.

Nucleic acid molecule: A nucleic acid molecule, an artificial nucleic acid, or nucleic acid is a molecule comprising, preferably consisting of nucleic acid components. The terms nucleic acid molecule, artificial nucleic acid, or nucleic acid preferably refer to DNA or RNA molecules and vice versa. It is preferably used synonymous with the term “polynucleotide”. Preferably, a nucleic acid molecule is a polymer comprising or consisting of nucleotide monomers, which are covalently linked to each other by phosphodiester-bonds of a sugar/phosphate-backbone. The terms “nucleic acid molecule”, “artificial nucleic acid” or “nucleic acid” also encompasses modified nucleic acid molecules, such as base-modified, sugar-modified or backbone-modified etc. It encompasses any type of DNA or RNA molecules.

Nucleic acid sequence/amino acid: The sequence of a nucleic acid molecule is typically understood to be the particular and individual order, i.e. the succession of its nucleotides. The sequence of a protein or peptide is typically understood to be the order, i.e. the succession of its amino acids.

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units. The term "polypeptide" as used herein, however, is typically not limited by the length of the molecule it refers to. In the context of the present invention, the term "polypeptide" may also be used with respect to peptides comprising less than 50 (e.g. 10) amino acids or peptides comprising even more than 600 amino acids. Also, the terms "polypeptide", "peptide", and "protein" are used interchangeably herein to refer to polymers of amino acids of any length.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. A poly(A) sequence is typically located at the 3'-end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector. Moreover, poly(A) sequences, or poly(A) tails may be generated in vitro by enzymatic polyadenylation of the RNA, e.g. using Poly(A)polymerases (PAP) derived from *E. coli* or yeast. In addition, polyadenylation of RNA can be achieved by using immobilized PAP enzymes e.g. in a polyadenylation reactor (WO 2016/174271).

Poly(C) sequence: A poly(C) sequence is typically a long sequence of cytosine nucleotides, typically about 10 to about 21100 cytosine nucleotides, preferably about 10 to about 100 cytosine nucleotides, more preferably about 10 to about 70 cytosine nucleotides or even more, preferably about 20 to about 50, or even about 20 to about 30 cytosine nucleotides. A poly(C) sequence may preferably be located 3' of the coding sequence comprised by a nucleic acid.

Polyadenylation: Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Polyvalent/polyvalent vaccine: A polyvalent vaccine, called also multivalent vaccine, containing antigens from more than one strain of a virus, or different antigens of the same virus, or any combination thereof. The term "polyvalent vaccine" describes that this vaccine has more than one valence. In the context of the invention, a polyvalent Norovirus vaccine would comprise a vaccine comprising an artificial nucleic acid encoding antigenic peptides or proteins derived from several different Norovirus strains or comprising artificial nucleic acid encoding different antigens from the same Norovirus strain, or a combination thereof. In preferred embodiment, a polyvalent Norovirus vaccine comprises 2, 3, 4, 5, 6, 7, 8, 9, 10, 11, 12, 13, 14, 15, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 88, 90, 91, 92, 93, 84, 95, 98, 97, 98, 99, 100 or even more different artificial nucleic acids each encoding at least one different antigenic peptide or protein. Methods to produce polyvalent mRNA vaccines are disclosed in the PCT application PCT/EP2016/82487.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different post-transcriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, a coding region, a 3'-UTR and a poly(A) sequence. Aside from messenger RNA, several non-coding types of RNA exist which may be involved in regulation of transcription and/or translation.

Stabilized nucleic acid, preferably mRNA: A stabilized nucleic acid, preferably mRNA typically, exhibits a modification increasing resistance to in vivo degradation (e.g. degradation by an exo- or endo-nuclease) and/or ex vivo degradation (e.g. by the manufacturing process prior to vaccine administration, e.g. in the course of the preparation of the vaccine solution to be administered). Stabilization of RNA can, e.g., be achieved by providing a 5'-cap-Structure, a Poly-A-Tail, or any other UTR-modification. It can also be achieved by chemical modification or modification of the G/C content of the nucleic acid or other types of sequence optimization. Various other methods are known in the art and conceivable in the context of the invention.

Sequence identity: Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. Hence, in the context of the present invention, identity of sequences preferably relates to the percentage of nucleotides of a sequence which have the same position in two or more sequences having the same length. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Serotype, serotype of a virus: A serotype or a serotype of a virus is a group of viruses classified together based on their antigens on the surface of the virus, allowing the epidemiologic classification of organisms to the sub-species level.

Strain, strain of a virus: A strain or a strain of a virus is a group of viruses that are genetically distinct from other groups of the same species. The strain that is defined by a genetic variant is also defined as a "subtype".

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction of the nucleic acid, preferably the mRNA is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the body's adaptive immune system to provide an adaptive immune response.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising a coding region. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding region and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

RNA in vitro transcription: The terms "RNA in vitro transcription" or "in vitro transcription" relate to a process wherein RNA is synthesized in a cell-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for in vitro transcription are known in the art (see, e.g., Geall et al. (2013) Semin. Immunol. 25(2):152-159: Brunelle et al. (2013) Methods Enzymol. 530:101-14). Reagents used in said method typically include:

1) a linearized DNA template with a promoter sequence that has a high binding affinity for its respective RNA polymerase such as bacteriophage-encoded RNA polymerases;
2) ribonucleoside triphosphates (NTPs) for the four bases (adenine, cytosine, guanine and uracil);
3) optionally a cap analogue as defined above (e.g. m7G(5')ppp(5')G (m7G)), optionally, fraction of NTPs optimized to the RNA sequence (according to WD/2015/188933);
4) a DNA-dependent RNA polymerase capable of binding to the promoter sequence within the linearized DNA template (e.g. T7, T3 or SP6 RNA polymerase);
5) optionally a ribonuclease (RNase) inhibitor to inactivate any contaminating RNase;
6) optionally a pyrophosphatase to degrade pyrophosphate, which may inhibit transcription;
7) MgCl2, which supplies Mg2+ ions as a co-factor for the polymerase;
8) a buffer to maintain a suitable pH value, which can also contain antioxidants (e.g. DTT), and/or polyamines such as spermidine at optimal concentrations.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound.

Different species/species: The term "species" defines a monophyletic group of viruses whose properties can be distinguished from those of other species by multiple criteria (Adams et al., 2013. Arch Virol 158: 2633-9). The reference to a "different" or "2, 3, 4, 5, 6, 7, 8, 9, 10, 11, 12, 13, 14, 15, 18, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different" GI, GII, GIII, GIV or GV, GI.1 or GII.4 Norovirus or Noroviruses as used in the present invention means that a Norovirus from another species, strain or serotype is used or that the properties of the Noroviruses which are used or utilized can be distinguished from those of the other Norovirus by multiple criteria.

3'-untranslated region (3'-UTR): Generally, the term "3'-UTR" refers to a part of the artificial nucleic acid molecule, which is located 3' (i.e. "downstream") of a coding region and which is not translated into protein. Typically, a 3'-UTR is the part of an mRNA which is located between the protein coding region (coding region or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. Preferably, the 3'-UTRs have a length of more than 20, 30, 40 or 50 nucleotides.

5'-untranslated region (5'-UTR): Generally, the term "5'-UTR" refers to a part of the artificial nucleic acid molecule, which is located 5' (i.e. "upstream") of a coding region and which is not translated into protein. A 5'-UTR is typically understood to be a particular section of messenger RNA (mRNA), which is located 5' of the coding region of the mRNA. Typically, the 5'-UTR starts with the transcriptional start site and ends one nucleotide before the start codon of the coding region. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post transcriptionally modified, for example by addition of a 5'-CAP. A 5'-UTR of the mRNA is not translated into an amino acid sequence. The 5'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 5'-UTR corresponds to the sequence of a mature mRNA which is located between the start codon and, for example, the 5'-cap. Preferably, the 5'-UTR corresponds to the sequence which extends from a nucleotide located 3' to the 5'-cap, more preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene" is the sequence which corresponds to the 5'-UTR of the mature mRNA derived from this gene, i.e. the mRNA obtained by transcription of the gene and maturation of the pre-mature mRNA. The term “5'-UTR of a gene” encompasses the DNA sequence and the RNA sequence (both sense and antisense strand and both mature and immature) of the 5'-UTR.

5'-Terminal Oligopyrimidine Tract (TOP): The 5'-terminal oligopyrimidine tract (TOP) is typically a stretch of pyrimidine nucleotides located in the 5'-terminal region of a nucleic acid molecule, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TDP. Messenger RNA that contains a 5'-terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TDP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TDP genes and TOP mRNAs, the TDP-motif preferably starts at its 5'-end with the transcriptional start site and ends one nucleotide 5' to the first purin residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called “TOP motif” in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as “TOP motif”.

TOP gene: TOP genes are typically characterised by the presence of a 5'-terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream coding regions (uORFs). Therein, upstream AUGs and upstream coding regions are typically understood to be AUGs and coding regions that occur 5' of the start codon (AUG) of the coding region that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1383 of the patent application WO 2013/143700, whose disclosure is incorporated herewith by reference. In this context a particularly preferred fragment of a 5'-UTR of a TOP gene is a 5'-UTR of a TOP gene lacking the 5'TOP motif. The terms “5'-UTR of a TOP gene” or “5'-TOP UTR” preferably refer to the 5'-UTR of a naturally occurring TOP gene.

Orthologues and paralogues: Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene. In the context of the invention, an orthologue and/or a paralogue of a Norovirus nucleic acid sequence of the invention preferably refers to a sequence having in increasing order of preference at least 50%, 51%, 52%, 53%, 54%, 55%, 56%, 57%, 58% 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 4411-39690, 39713-39748. In the context of the invention, an orthologue and/or a paralogue of a Norovirus amino acid sequence of the invention refers preferably to a sequence having in increasing order of preference at least 50%, 51%, 52%, 53%, 54%, 55%, 56%, 57%, 58%, 59%, 60%, 61%, 62%, 63%, 64%, 65%, 68%, 67%, 68%, 69%, 70%, 71%, 72%, 73%, 74%, 75%, 76%, 77%, 78%, 79%, 80%, 81%, 82%, 83% 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 1-4410.

Hybridization/Homology: Nucleic acid molecules which are advantageously for the process according to the invention can be isolated based on their homology to the nucleic acid molecules or a complement sequence of the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the invention or encoding a protein used in the invention or of the nucleic acid molecule of the invention. Nucleic acid molecules with 35, 50, 100, 250 or more nucleotides may also be used.

The term “homology” means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other species, strains, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions.

By "hybridizing" it is meant that such nucleic acid molecules hybridize under conventional hybridization conditions, preferably under stringent conditions such as described by, e.g., Sambrook (Molecular Cloning: A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, no limiting example of stringent hydridization conditions are hybridizations in 6× sodium chloride/sodium citrate (=SSC) at approximately 45° C., followed by one or more wash steps in 1.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C. 40° C., 45° C., 50° C. or 55° C., preferably between 45° C. and 55° C. The abovementioned hybridization temperatures are determined for example for a nucleic acid approximately 101 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2×SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SOS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Some examples of conditions for DNA hybridization (Southern blot assays) and wash step are shown herein below:

(1) Hybridization conditions can be selected, for example, from the following conditions:
- a) 4×SSC at 65° C.,
- b) 6×SSC at 45° C.,
- c) 6×SSC, 100 mg/ml denatured fragmented fish sperm DNA at 68° C.,
- d) 6×SSC, 0.5% SOS, 100 mg/ml denatured salmon sperm DNA at 68° C.,
- e) 6×SSC, 0.5% SDS, 100 mg/ml denatured fragmented salmon sperm DNA, 50% formamide at 42° C.,
- f) 50% formamide, 4×SSC at 42° C.,
- g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
- h) 2× or 4×SSC at 50° C. (low-stringency condition), or
- i) 30 to 40% formamide, 2× or 4×SSC at 42° C. (low-stringency condition).

(2) Wash steps can be selected, for example, from the following conditions:
- a) 0.015 M NaCl/0.0015 M sodium citrate/0.1% SOS at 50° C.
- b) 0.1×SSC at 65° C.
- c) 0.1×SSC, 0.5% SDS at 68° C.
- d) 0.1×SSC, 0.5% SOS, 50% formamide at 42° C.
- e) 0.2×SSC, 0.1% SDS at 42° C.
- f) 2×SSC at 65° C. (low-stringency condition).

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE, 0.1% SDS). A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the methods of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

To determine the percentage homology (=identity, herein used interchangeably) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98: W. R. Pearson and D. J. Lipman (1988) Improved Tools for Biological Sequence Comparison. PNAS 85:2444-2448: W. R. Pearson (1990); Rapid and Sensitive Sequence Comparison with FASTP and FASTAMethods in Enzymology 183:83-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences: -p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output: 8=tabular; 9 tabular with comment lines [Integer]: default=0; -o BLAST report Output File [File Out] Optional; default=stdout; -F Filter query sequence (DUST with blastn, SEB with others) [String]; default=T; -G Cost to open a gap (zero invokes default behavior) [Integer]; default=D; -E Cost to extend a gap (zero invokes default behavior) [Integer]: default=0: -X X drop-off value for gapped alignment (in bits) (zero invokes default behavior); blastn 30, mega blast 21, tblastx 0, all others 15 [Integer]; default=0; -l Show GI's in deflines [T/F]; default=F; -q Penalty for a nucleotide mismatch (blastn only) [Integer]; default=−3; -r Reward for a nucleotide match (blastn only) [Integer]: default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, mega blast 0 [Integer]; default=0; -g Perfom gapped alignment (not available with tblastx) [T/F]; default=T; -Q Query Genetic code to use [Integer]; default=1; -D DB Genetic code (for tblast [nx] only) [Integer]; default=1; -a Number of processors to use [Integer]; default=; -O SeqAlign file [File Out] Optional; -J Believe the query defline [T/F]; default=F; -M Matrix [String]; default=BLOSUM62; -W Word size, default if zero (blastn II, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F: -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0: -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0: -w Frame shift penalty (00F algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351 (1987), Higgins et al., CABIOS 5, 151 (1989)) or preferably with the programs "Gap" and "Needle", which are both based on the algorithms of Needleman and Wunsch (J. Mol. Biol. 48; 443

(1970)), and "BestFit", which is based on the algorithm of Smith and Waterman (Adv. Appl. Math. 2; 482 (1981)). "Gap" and "BestFit" are part of the GCG software-package (Genetics Computer Group, 575 Science Drive, Madison, Wis., USA 53711 (1991); Altschul et al., (Nucleic Acids Res. 25, 3389 (1997)), "Needle" is part of the European Molecular Biology Open Software Suite (EMBOSS) (Trends in Genetics 16 (B), 276 (2000)). Therefore preferably the calculations to determine the percentages of sequence homology are done with the programs "Gap" or "Needle" over the whole range of the sequences. The following standard adjustments for the comparison of nucleic acid sequences were used for "Needle": matrix: EDNAFULL, Gap_penalty: 10.0. Extend_penalty: 0.5. The following standard adjustments for the comparison of nucleic acid sequences were used for "Gap": gap weight: 50, length weight: 3, average match: 10.000, average mismatch: 0.000.

For example a sequence, which has 80% homology with sequence SEQ ID NO: 4411 at the nucleic acid level is understood as meaning a sequence which, upon comparison with the sequence SEQ ID NO: 4411 by the above program "Needle" with the above parameter set, has a 80% identity.

Homology between two polypeptides is understood as meaning the identity of the amino acid sequence over in each case the entire sequence length which is calculated by comparison with the aid of the above program "Needle" using Matrix: EBLOSUM62, Gap_penalty: 8.0, Extend_penalty: 2.0.

For example a sequence which has a 80% homology with sequence SEQ ID NO: 1 at the protein level is understood as meaning a sequence which, upon comparison with the sequence SEQ ID NO: 1 by the above program "Needle" with the above parameter set, has a 80% identity.

DETAILED DESCRIPTION

In a first aspect, the invention relates to an artificial nucleic acid comprising or consisting of at least one coding region encoding at least one polypeptide derived from a Norovirus, and/or a fragment or variant thereof. In another embodiment, the artificial nucleic acid comprises at least one coding region encoding at least one polypeptide comprising or consisting of at least one Norovirus capsid protein, and/or a fragment or variant thereof.

In one embodiment, the artificial nucleic acid molecule according to the invention comprises at least one coding region encoding the Norovirus capsid protein VP1 or VP2. In another embodiment, the artificial nucleic acid encodes Norovirus capsid protein VP1. In this context, a reference to a Norovirus capsid protein VP1 equals a reference to a VP1 capsid protein derived from a Norovirus, a Norovirus VP1, capsid protein, capsid protein VP1, major capsid protein, major capsid protein VP1, major capsid region, major viral capsid protein, or VP1 capsid protein.

In particular, the invention relates to an artificial nucleic acid comprising or consisting of at least one coding region encoding at least one polypeptide selected from the group consisting of Norovirus capsid protein VP1 (also termed "Major capsid protein" or "capsidprotein"), Norovirus capsid protein VP2 (also termed "Minor capsid protein") and/or a Norovirus non-structural protein, such as NS1/NS2 (also termed p48 or Nterm (amino terminal protein)), NS3 (also termed NTPase or Nucleoside triphosphatase), NS4 (also termed p22 or 3A-like protein), NS5 (also termed VP1 or Genome-linked viral protein), NS6 (also termed Pro or Proteinase), or NS7 (also termed Pol or RNA-dependent RNA polymerase), and/or a fragment or variant of any of these proteins.

In one embodiment of the invention, vaccines and/or compositions contain VP1 proteins and/or VP2 proteins. Preferably each vaccine and/or composition contains VP1 and/or VP2 proteins from only one Norovirus genogroup giving rise to a monovalent vaccine. As used herein, the term "monovalent" means the antigenic proteins are derived from a single Norovirus genogroup. For example, the vaccines and/or compositions contain VP1 and/or VP2 from a virus strain of genogroup I (e.g. VP1 and VP2 from Norwalk virus).

Preferably the vaccines and/or compositions are comprised of predominantly VP1 proteins. In one embodiment of the invention, the antigen is a mixture of monovalent vaccines and/or compositions wherein the composition includes vaccines and/or compositions comprised of VP1 and/or VP2 from a single Norovirus genogroup mixed with vaccines and/or compositions comprised of VP1 and/or VP2 from a different Norovirus genogroup taken from multiple viral strains (e.g. a Norovirus from Genogroup IV.2 and a Norovirus from Genogroup I.1). Purely by way of example the composition can contain monovalent vaccines and/or compositions from one or more strains of Norovirus genogroup I together with monovalent vaccines and/or compositions from one or more strains of Norovirus genogroup II. Preferably, the Norovirus vaccines and/or composition mixture is composed of the Norovirus from Genogroup IV.2 and Norovirus from Genogroup I.1 or from different genus or species of a Norovirus from Genogroup IV.2.

Preferably the vaccines and/or compositions are comprised of predominantly VP1 proteins. In one embodiment of the invention, the antigen is a mixture of monovalent vaccines and/or compositions wherein the composition includes vaccines and/or compositions comprised of VP1 and/or VP2 from a single Norovirus genogroup mixed with vaccines and/or compositions comprised of VP1 and/or VP2 from a different Norovirus genogroup taken from multiple viral strains (e.g. a Norovirus from Genogroup IV.2 and a Norovirus from genogroup I.1). Purely by way of example the composition can contain monovalent vaccines and/or compositions from one or more strains of Norovirus genogroup I together with monovalent vaccines and/or compositions from one or more strains of Norovirus genogroup II. Preferably, the Norovirus vaccines and/or composition mixture is composed of the Norovirus from Genogroup II.4 and Norovirus from Genogroup I.1 or from different genus or species of a Norovirus from Genogroup II.4.

In this context, the amino acid sequence of the at least one antigenic peptide or protein may be selected from any peptide or protein derived from a capsid protein VP1, capsid protein VP2, NS1/NS2, NS3, NS4, NS5, NS6, or NS7 of a Norovirus or a fragment or variant thereof.

Further, in an alternative embodiment of the invention, the vaccines and/or compositions may be multivalent vaccines and/or compositions that comprise, for example, VP1 and/or VP2 proteins from one Norovirus genogroup intermixed with VP1 and/or VP2 proteins from a second Norovirus genogroup, wherein the different VP1 and VP2 proteins are not chimeric VP1 and VP2 proteins, but associate together within the same capsid structure to form immunogenic Vaccines and/or compositions. As used herein, the term "multivalent" means that the antigenic proteins are derived from two or more Norovirus genogroups. Multivalent vaccines and/or compositions may contain vaccines and/or composition antigens taken from two or more viral strains.

Purely by way of example the composition can contain multivalent vaccines and/or compositions comprised of capsid monomers or multimers from one or more strains of Norovirus genogroup I together with capsid monomers or multimers from one or more strains of Norovirus genogroup II. Preferably, the Norovirus vaccines and/or composition mixture is composed of the Norovirus from Genogroup IV.2 and Norovirus from Genogroup I.1 or from different genus or species of a Norovirus from Genogroup IV.2.

Further, in an alternative embodiment of the invention, the vaccines and/or compositions may be multivalent vaccines and/or compositions that comprise, for example, VP1 and/or VP2 proteins from one Norovirus genogroup intermixed with VP1 and/or VP2 proteins from a second Norovirus genogroup, wherein the different VP1 and VP2 proteins are not chimeric VP1 and VP2 proteins, but associate together within the same capsid structure to form immunogenic Vaccines and/or compositions. As used herein, the term "multivalent" means that the antigenic proteins are derived from two or more Norovirus genogroups. Multivalent vaccines and/or compositions may contain vaccines and/or composition antigens taken from two or more viral strains. Purely by way of example the composition can contain multivalent vaccines and/or compositions comprised of capsid monomers or multimers from one or more strains of Norovirus genogroup I together with capsid monomers or multimers from one or more strains of Norovirus genogroup II. Preferably, the Norovirus vaccines and/or composition mixture is composed of the Norovirus from Genogroup II.4 and Norovirus from Genogroup I.1 or from different genus or species of a Norovirus from Genogroup II.4.

In another embodiment, the artificial nucleic acid may comprise 2, 3, 4, 5, 6, 7, 8, 9, 10 or more coding regions encoding at least one polypeptide selected from the group consisting of Norovirus capsid protein VP1, Norovirus capsid protein VP2, NS1/NS2, NS3, NS4, NS5, NS6, or NS7, and/or a fragment or variant of any of these proteins.

In a preferred embodiment, the compositions or vaccines of the present invention comprise a multivalent vaccine, e.g., comprising a polynucleotide which encodes at least two different VP1, for example a Norovirus capsid protein VP1 from a GII.4 strain and a Norovirus capsid protein VP1 from a GI.1 strain. In another embodiment, the compositions or vaccines comprises a multivalent vaccine, e.g., comprising two different polynucleotides, whereby one polynucleotide encodes for example a Norovirus capsid protein VP1 from a GII.4 strain and the other polynucleotide encodes a Norovirus capsid protein VP1 from a GI.1 strain.

In a further embodiment, the compositions or vaccines of the present invention may comprise a multivalent vaccine, e.g., comprising a polynucleotide which encodes at least two different VP1, for example a Norovirus capsid protein VP1 from two different GII.4 strains. In another embodiment, the compositions or vaccines comprise a multivalent vaccine, e.g., comprising two different polynucleotides, whereby one polynucleotide encodes for example a Norovirus capsid protein VP1 from two different GII.4 strains.

In some embodiments, as defined above, the composition or the vaccine is multivalent, i.e. compositions or vaccines of the present invention may vary in their valency. Valency refers to the number of antigenic components in the composition or vaccine. In some embodiments, the compositions or vaccines are monovalent. In some embodiments, the compositions or vaccines are divalent or bivalent. In some embodiments the compositions or vaccines are trivalent. In some embodiments the compositions or vaccines are teravalent. In some embodiments the compositions or vaccines are multi-valent. Multivalent vaccines may comprise at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 38, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 7, 68, 89, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more antigens or antigenic moieties (e.g., antigenic peptides, etc.). The antigenic components of the compositions or vaccines may be on a single polynucleotide or on separate polynucleotides. In another embodiment, multivalent vaccines may comprise or at least 10, 15, 20, 30, 40 or 50 or 100 or more antigens or antigenic moieties (e.g., antigenic peptides, etc.). In another embodiment, multivalent vaccines may comprise 2-10, 10-15, 15-20, 20-50, 50-100 or 100-200 or more antigens or antigenic moieties (e.g., antigenic peptides, etc.).

In a preferred embodiment, the multivalent composition or vaccine comprises about 30 to about 50 antigens or antigenic moieties.

In some embodiments, the open reading frame of the one or more RNA polynucleotides encodes at least 2, 3, 4, 5, 6, 7, 8, 9 or 10 or at least 10, 15, 20 or 50 or 2-10, 10-15, 15-20, 20-50, 50-100 or 100-200 antigenic polypeptides.

In this context it is particularly preferred that the composition comprises at least two mRNA sequences, wherein at least one mRNA sequence encodes at least one antigenic peptide or protein, i.e. VP1, is derived from a GII.4 Norovirus and at least one mRNA sequence encodes at least one antigenic peptide or protein, derived from Norovirus VP1, is derived from another GII.4 Norovirus.

In another preferred embodiment each mRNA sequence encodes at least one different antigenic peptide or protein derived from proteins of different Noroviruses. Preferably each mRNA sequence encodes at least one antigenic peptide or protein, derived from Norovirus VP1, of different GII.4 Noroviruses or different GI.1 Noroviruses, or a combination thereof.

In a further embodiment, the invention relates to a composition comprising or consisting of 2, 3, 4, 5, 6, 7, 8, 8, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 55, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more separate artificial nucleic acids selected from the group of SEQ ID NOs: 4411-39890, 39713-39746 comprising at least one coding region encoding at least one polypeptide derived from a Norovirus selected from the group SEQ ID NOs: 1-4410 or a fragment or variant of any of these proteins.

In some embodiments, the open reading frame of the one or more RNA polynucleotides encode at least 10, 15, 20, 30, 40 or 50 or 100 antigenic polypeptides. In some embodiments, the open reading frame of the one or more RNA polynucleotides encode 2-10, 10-15, 15-20, 20-50, 50-100 or 100-200 antigenic polypeptides.

The present invention is based on the surprising finding that the at least one Norovirus protein comprised in the at least one polypeptide encoded by the artificial nucleic acid as described herein can efficiently be expressed in a mammalian cell. It was further unexpectedly found that the artificial nucleic acid is suitable for eliciting an immune response against Norovirus in a subject.

Furthermore, the present invention is based on the surprising finding that mRNA-based or artificial nucleic acid vaccines comprising mRNA or artificial nucleic acid sequences encoding different antigens of a Norovirus (particularly Norovirus capsid protein VP1) were extremely effective in inducing an antigen-specific immune response against Norovirus. Furthermore, the inventors surprisingly found that many mRNA sequences encoding different antigens of different Noroviruses can be effectively combined in one mRNA-based vaccine.

In one embodiment, the artificial nucleic acid of the invention comprises at least one coding region encoding at least one polypeptide derived from a Norovirus and/or a fragment or variant thereof.

In a further embodiment, the artificial nucleic acid of the invention comprises at least one coding region encoding at least one polypeptide selected from the group consisting of a non-structural protein derived from a Norovirus and/or a capsid protein derived from a Norovirus, and/or a fragment or variant thereof.

In a further embodiment, the artificial nucleic acid of the invention comprises at least one coding region encoding at least one polypeptide selected from the group consisting of Norovirus non-structural proteins NS1/NS2, NS3, NS4, NS5, NS6, NS7, Norovirus capsid protein VP1 and Norovirus capsid protein VP2, and/or a fragment or variant thereof.

Norovirus:

In the context of the present invention, the term "Norovirus" comprises any Norovirus, irrespective of strain or origin. Preferably, the term "Norovirus" comprises a Norovirus strain selected from the group consisting of Genogroup I, Genogroup II, Genogroup III, Genogroup IV, or Genogroup V (abbreviated as I, II, GIII, GIV or GV, respectively).

In a further embodiment, the term "Norovirus" comprises a Norovirus strain selected from the group consisting of (i) Genogroup I genotype 1 (abbreviated as GI.1), GI.2, GI.3, GI.4, GI.5, GI.6, GI.7, GI.8, GI.9, GI.10, GI.11, GI.12, GI.13, GI.14, GI.15. GI.16 and/or GI.17;

(ii) Genogroup II genotype 1 (abbreviated as GII.1), GII.2, GII.3, GII.4, GII.5, GII.6, GII.7, GII.8, GII.9, GII.10, GII.11, GII.12, GII.13, GII.14, GII.15, GII.16, GII.17, GII.18, GII.19, GII.20, GII.21, GII.22, GII.23, and/or GII.24;

(iii) Genogroup III genotype 1 (abbreviated as GIII.1), GIII.2, GIII.3, and/or GIII.4;

(iv) Genogroup IV genotype 1 (abbreviated as GIV.1), GIV.2, GIV.3, and/or GIV.4;

(v) Genogroup V genotype 1 (abbreviated as GV.1), GV.2, GV.3, and/or GV.4;

and/or combinations of 2, 3, 4, 5, 6, 7, 8, 9, or 10, or more of any of the above Noroviruses from different Genogroups and/or different Genotypes.

In a further embodiment, the nucleic acid of the invention, preferably a VP1 nucleic acid derived from a Norovirus, is derived from a Norovirus selected from the group consisting of (i) Genogroup I genotype 1 (abbreviated as GI.1). GI.2, GI.3, GI.4, GI.5, GI.6, GI.7, GI.8, GI.9, GI.10, GI.11, GI.12, GI.13. GI.14, GI.15, GI.16 and/or GI.17;

(ii) Genogroup II genotype 1 (abbreviated as GII.1), GII.2, GII.3, GII.4, GII.5, GII.6, GII.7, GII.8, GII.9, GII.10, GII.11, GII.12, GII.13, GII.14, GII.15, GII.16, GII.17, GII.18, GII.19, GII.20, GII.21, GII.22, GII.23, and/or GII.24;

(iii) Genogroup III genotype 1 (abbreviated as GIII.1), GIII.2, GIII.3, and/or GIII.4;

(iv) Genogroup IV genotype 1 (abbreviated as GIV.1). GIV.2, GIV.3, and/or GIV.4; and (v) Genogroup V genotype 1 (abbreviated as GV.1), GV.2, GV.3, and/or GV.4.

In the case, 2, 3, 4, 5, 6, 7, 8, 9, 10 or more different VP1 nucleic acids are utilized or employed, for example in a composition of the invention or a vaccine of the invention, the VP1 nucleic acids can be derived from 2, 3, 4, 5, 6, 7, 8, 9, or 10, or more of any of the above Noroviruses from different Genogroups and/or different Genotypes.

In the context of the invention, a reference to GI.1 to GI.17 means a reference to GI.1, GI.2, GI.3, GI.4, GI.5, GI.6, GI.7, GI.8, GI.9, GI.10, GI.11, GI.12, GI.13, GI.14, GI.15, GI.16 and/or GI.17; a reference to GII.1 to GII.24 means a reference to GII.1, GII.2, GII.3, GII.4, GII.5, GII.6, GII.7, GII.8, GII.9, GII.10, GII.11, GII.12, GII.13, GII.14, GII.15, GII.16, GII.17, GII.18, GII.19, GII.20, GII.21, GII.22, GII.23, and/or GII.24; a reference to GIII.1 to GIII.4 means to a reference to GIII.1, GIII.2, GIII.3, and/or GIII.4; a reference to GIV.1 to GIV.4 means to a reference to GIV.1, GIV.2, GIV.3, and/or GIV.4; a reference to GV.1 to GV.4 means to a reference to GV.1, GV.2, GV.3, and/or GV.4.

In other embodiments, the term "Norovirus" comprises a Norovirus strain selected from the group consisting of a GII.4 Norovirus and/or a GI.1 Norovirus. In a further embodiment, the term "Norovirus" as used herein refers to Norovirus GII.4 CIN-1 (also termed Norovirus Hu/GII.4/031693/USA/2003 or having Accession No. JQ965810.1), GII.4 (Accession No: AY502023.1), GII.4 CIN-002 and/or GII.4 Sydney. In another embodiment, the Norovirus is a GII.4 Sydney Norovirus or a GII.4 Sydney 2012 Norovirus.

In other embodiments, the term "Norovirus" comprises a Norovirus strain selected from the group consisting of a GII.4 Norovirus and/or a GI.1 Norovirus. In a further embodiment, the term "Norovirus" as used herein refers to Norovirus GII.4-031693-USA-2003, Norovirus GII.4/Farmington Hills/2002/USA, Norovirus GII.4-2006b 092895-USA-2008, Norovirus GII.4-GZ2010-L87-Guangzhou-2011, Norovirus GII.4-USA-1997, Norovirus GI.1-USA-1968-Capsidprotein.

In another embodiment, the term "Norovirus" comprises a Norovirus strain selected from the group consisting of Norovirus Hu/GII.4/Dijon/E872/2002/FRA, Norovirus Hu/GII.4/MD120-12/1987/USA, Norovirus Hu/GII.1/7EK/Hawaii/1971/USA, Norovirus Hu/GII.6/CHDC4073/1984/USA, Norovirus Hu/GII.4/Hiroshima/19/2001/JPN, Norovirus Hu/GII.4/Hiroshima/97/2006/JPN, Norovirus Hu/GII/JP/2015/GII.Pe_GII.4/Osaka/OSF78, Norovirus GII/Hu/NL/2012/GII.4/Groningen, Norovirus GII/Hu/NL/2014/GII.2/Groningen, Norovirus Hu/GII.4/New Orleans1500/2008/USA, Norovirus Hu/GII.6/Ohio/490/2012/USA, Norovirus Hu/GII.3/Jingzhou/2013402/CHN, Norovirus Hu/GII.4/Jingzhau/2013403/CHN, Norovirus Hu/GII.17/Gaithersburg/2014/US, Norovirus Hu/GII.4/C127/GF/1978, Norovirus Hu/GII.4/CHDC3967/1988/03, Norovirus Hu/GII.4/CHDC4108/1987/US, Norovirus Hu/GII.4/CHDC4871/1977/US, Norovirus Hu/GII.3/CHDC5291/1990/US, Norovirus Hu/GII.3/Milwaukee009/2010/USA, Norovirus Hu/GII.4/Miranda/NSW817L/2010/AU, Norovirus Hu/GII.2/KL109/MY/1978, Norovirus Hu/GII.14/HK74/CN/1978, Norovirus Hu/GII.7/HK4/CN/1976, Norovirus Hu/GII.17/C142/GF/1978, Norovirus Hu/GII.5/C15/GF/1978, Norovirus Hu/GI.5/E57/UG/1975, Norovirus Hu/GII.4/Randwick/NSW882J/2011/AU, Norovirus Hu/GII.4/Berowra/NSW767L/2012/AU, Norovirus Hu/GII.4/Sydney/NSW0514/2012/AU, Norovirus Hu/GII.4/Hong Kong/CUHK3830/2012/CHN, Norovirus Hu/GII.4/VP1172/Shanghai/2012/CHN, Norovirus Nu/GII-4/New Taipei/CGMH61/2012/TW, Norovirus GII/Hu/HKG/

2013/GII.4/CUHK-NS-141, Norovirus GII/Hu/JP/2002/GII.P12_GII.13/Saitama/TBD, Norovirus GII/Hu/JP/2001/GII.P12_GII.12/Saitama/T15, Norovirus GII/Hu/JP/2007/GII.P21_GII.21/, Kawasaki/Y0284, Norovirus GII/Hu/JP/2007/GII.P15_GII.15/Sapporo/HK299, Norovirus GI/Hu/JP/2007/GI.P3_GI.3/Shimizu/KK2866, Norovirus GII/Hu/JP/2007/GII.P7_GII.14/Fukuoka/KK282, Norovirus GI/Hu/JP/2007/GI.P8_GI.8/Nagoya/KY531, Norovirus Hu/GII.4/SJTUH1/CHN/2014, Norovirus Hu/GII.4/variant Sydney 2012/FRA, Norovirus Hu/GII-4/Hokkaido4/2006/JP, Norovirus GIV/Hu/Jp/2001/GIV.1/OCO1017023, Norovirus Hu/GII.4/Beijing/53671/2007/CHN, Norovirus Hu/II.4/2200661/HK/2010, Norovirus Hu/GII.4/Aichi368-14/2014, Norovirus Hu/GII.4/Hunter 284E/040/AU, Norovirus Hu/GII-4/Osaka/1998/JPN, Norovirus Hu/GI.1/P774.Delsjo2004/Gothenburg/Sweden, Norovirus pig/GII.11/F18-10/2005/CAN, Norovirus Hu/GII.4/Wellington/1995/USA, Norovirus Hu/GII.4/Henry/2000/USA, Norovirus Hu/GII.4/SSCS/2005/USA, Norovirus GII/Hu/IN/2006/GII.P4_GII.4_Yerseke2006a/Pune-PC21, Norovirus Hu/GI.1/P7-587/2007/Stromstad/Sweden, Norovirus Hu/GI.2/Leuven/2003/BEL, Norovirus Hu/GII.7/NSW743L/2008/AUS, Norovirus Hu/GII.2/NF2002/USA/2002, Norovirus Hu/GII.4/NF2003/USA/2003, Norovirus Hu/GII.3/1999, Norovirus Hu/GIV.1/Ahrenshoop246/DEU/2012, Norovirus Hu/GII.4/Xi'an/P19/2010/CHN, Norovirus Hu/GII.4/PA363/2011/ITA, Norovirus Hu/GII.4/P3/2012/Gothenburg/Sweden, Norovirus Hu/GII.4/Tanger/TM687/2011/MAR, Norovirus 12-X-2/2012/GII.P22/GII.5, Norovirus Hu/GII.4/Kobe034/2006/JP, Norovirus Hu/GGII.4/Tie1001/1995/NL, Norovirus Hu/GGII.4/DenHaag015/2000/NL, Norovirus Hu/GGII.4/Schiedam018/2001/NL, Norovirus Hu/GGII.4/Apeldoorn023/2003/NL, Norovirus Hu/GGII.4/Middelburg007/2004/NL, Norovirus Hu/GII-4/Matsudo/021071/2002/JP, Norovirus Hu/GII-4/Kaiso/030556/2003/JP, Norovirus Hu/GII-4/Awa/040354/2004/JP, Norovirus Hu/GII.4/Apeldoorn317/2007/NL, Norovirus Hu/GII.2/Rotterdam39E/2002/NL, Norovirus Hu/GII.4/RotterdamP2D0/2005/NL, Norovirus Hu/GII.4/Stockholm/19865/2008/SE, Norovirus Hu/GII.6/OC04062VLP/2004/JP, Norovirus Hu/GII.4/HS194/2009/US, Norovirus Hu/GII.12/HS210/2010/USA, Norovirus Hu/GI.0/8FIIa/1968/USA, Norovirus Hu/GII.4/CHDC5191/1974/USA, Norovirus Hu/GII.4/N76/2010/HuZhou, Norovirus Hu/GII.6/S9c/1976/SEN, Norovirus Hu/GII.4/KL45/1978/MYS, Norovirus Hu/GII.4/NIHIC17.5/2012/USA, Norovirus Hu/GII.4/NIHIC9/2011/USA, Norovirus Hu/GII.4/C110/1978/GUF, Norovirus Hu/GII.4/HS66/2001/USA, Norovirus Hu/GII/JP/2015/GII.P17_GII.17/Kawasaki308, Norovirus Hu/GII/JP/2014/GII.P17_GII.17/Nagano8-1, Norovirus Hu/GII/JP/2015/GII.Pe_GII.4/Osaka/DSF78, Norovirus GI/Hu/NL/2011/GI.4/Groningen, Norovirus GII/Hu/NL/2014/GII.4/Groningen01, Norovirus Hu/GII.4/Kenepuru/NZ327/2006/NZL, Norovirus Hu/GII.4/Rathmines/NSW287R/2007/AUS, Norovirus Hu/GII.4/Turramurra/NSW892U/2009/AUS, Norovirus Hu/GII.4/Seoul/0389/2009/KDR, Norovirus Hu/GII.4/Seoul/0945/2009/KDR, Norovirus Hu/GII.12/Shelby/2009/USA, Norovirus Hu/GI.7/TCH-060/USA/2003, Norovirus Hu/GII.1/Ascension208/2010/USA, Norovirus Hu/GII.13/VAI73/2010/USA, Norovirus Hu/GII.21/Salisbury150/2011/USA, Norovirus Hu/GII.4/1997/USA, Norovirus Hu/GII.4/Farmington Hills/2004/USA, Norovirus Hu/GII.4/Minerva/2006/USA, Norovirus Hu/GII.4/Ohio/71/2012/USA, Norovirus Hu/GII.4/AlbertaEI065/2011/CA, Norovirus Hu/GII.4/SG4051-09/2009/SG, Norovirus Hu/GII.3/TCH-104/USA/2002, Norovirus Hu/GI.6/TCH-099/USA/2003, Norovirus 06-AM-11/2006/GII.4/Yerseke/2006a, Norovirus 09-BI-2/2009/GII.4/NewOrleans/2009, Norovirus Hu/GII.4/PR328/2013/ITA, Norovirus Hu/GII.P17_GII.17/PR668/2015/ITA, Norovirus Hu/GII.4/AlbertaSPI/2013/CA, Norovirus Hu/GII.4/C00007892/2011/UK, Norovirus Hu/GII.6/GZ2010-L96/Guangzhou/CHN/2011, Norovirus Bo/GIII.1/Aba-Z5/2002/HUN, Norovirus GI.9, Norovirus Hu/GII.17/CUHK-NS-670/HKG/2015, Norovirus GII/Hu/SI/2015/GII.17/Ljubljana1662, Norovirus Hu/GII.17/CUHK-NS-647/HKG/2015, Norovirus Hu/GII.21/CUHK-NS-609/HKG/2015, Norovirus Hu/GII.4/Melbourne6623/2016/AUS, Norovirus GII/Hu/JP/2016/GII.P16_GII.4_Sydney2012/OH16002, Norovirus Hu/GII/JP/2016/GII.P16_GII.4_Sydney2012/Kawasaki194, Norovirus 16F2149_GII.2_Guangdong_CHN_2016, Norovirus Hu/GII.17/CUHK-NS-864/HKG/2016, Norovirus GII/Hu/ZAF/2012/GII.P4_GII.4/CapeTown/9772, Norovirus GII.12, Snow Mountain virus, Human calicivirus strain Melksham.

In one embodiment, the artificial nucleic acid is derived from a Norovirus selected from the group consisting of genogroup I Norovirus, genogroup II Norovirus, genogroup III Norovirus, genogroup IV Norovirus, and genogroup V Norovirus; preferably the artificial nucleic acid is derived from a Norovirus selected from the group consisting of a GI.1 to GI.17 Norovirus, GII.1 to GII.24 Norovirus, GIII.1 to GIII.4 Norovirus, GIV.1 to GIV.4 Norovirus and GV.1 to GV.4 Norovirus; more preferably, the artificial nucleic acid is derived from a Norovirus selected from the group consisting of GI.1 Norovirus and 011.4 Norovirus, even more preferably, the artificial nucleic acid is derived from a GII.4 Norovirus, still more preferably, the artificial nucleic acid is derived from a GII.4 CIN-1 Norovirus or a GII.4 Sydney Norovirus or a GII.4 Sydney 2012 Norovirus.

In preferred embodiments, the artificial nucleic acid is derived from a Norovirus selected from the group consisting of Norovirus GII.4-031093-USA-2003, Norovirus GII.4/Farmington Hills/HU/USA, Norovirus GII.4-2006b 092895-USA-2008, Norovirus GII.4-GZ2010-L87-Guangzhou-2011, Norovirus GII.4-USA-1997, Norovirus GI.1-USA-1968-Capsidprotein.

Norovirus Peptides or Proteins:

The at least one polypeptide encoded by the at least one coding region of the inventive artificial nucleic acid comprises at least one Norovirus protein. The RNA genome of Norovirus typically encodes a plurality of structural and non-structural proteins.

Translation of Norovirus RNA typically leads to a precursor protein comprising a plurality of individual viral (structural and non-structural) proteins (or precursor of these proteins) in one polypeptide chain, which is typically referred to as "polyprotein" or "precursor protein".

In the context of the present invention, a Norovirus polyprotein typically comprises amino acid sequences that are target sites for enzymes that specifically cleave the polyprotein in order to yield fragments of the polyprotein, wherein the fragments preferably comprise an individual Norovirus protein or two or more Norovirus proteins, or a fragment or variant thereof. In the context of the present invention, the term "polyprotein" may also refer to a polypeptide chain comprising the amino acid sequences of at least two individual Norovirus proteins, or a fragment or variant thereof. Cleavage of a Norovirus polyprotein preferably occurs between individual Norovirus proteins (e.g. between the capsid protein VP1 and the capsid protein VP2, or fragments or variants thereof. An individual Norovirus protein, or a fragment or variant thereof, e.g. as obtained from a polyprotein by cleavage, is preferably referred to as "mature Norovirus protein". In the context of the present invention, the term "mature Norovirus protein" is not limited to an individual Norovirus protein, or a fragment or variant thereof, which was generated by cleavage of a polyprotein, but also comprises an individual Norovirus protein of another origin, such as an individual Norovirus protein expressed recombinantly from an artificial nucleic acid. Preferably, a mature Norovirus protein lacks an amino acid sequence that is typically present in a corresponding amino acid sequence encoding said Norovirus protein in a Norovirus polyprotein (precursor protein) and wherein said amino acid sequence lacking in the mature Norovirus protein preferably corresponds to an amino acid sequence, which is usually removed by cleavage during processing of a Norovirus polyprotein. For example, an amino acid sequence, which is a target site for a protease, may be present in a Norovirus polyprotein, but may be absent from a mature Norovirus protein derived from said Norovirus polyprotein.

In one embodiment, the artificial nucleic acid comprising at least one coding region encoding at least one polypeptide comprises at least one Norovirus capsid protein VP1 or Norovirus capsid protein VP2 and/or a fragment or a variant thereof.

In another embodiment, the artificial nucleic acid comprising at least one coding region encoding at least one polypeptide comprises at least one Norovirus capsid protein VP1 and/or a fragment or variant thereof. In a further embodiment, the artificial nucleic acid comprises a Norovirus capsid protein VP1 and/or a fragment or variant thereof.

In the context of the present invention, the term "Norovirus protein" may refer to any amino acid encoded by a Norovirus nucleic acid. In the context of the invention, a Norovirus capsid protein VP1 or VP1 protein is preferred. For example, a "Norovirus protein" may be any polypeptide comprising or consisting of an amino acid sequence according to any one of the following amino acid sequences from Genbank, or a fragment or variant of any of these sequences as provided in Table 1 (Column 2; "NCBI or Genbank Accession No.") and Table 3 (Column 2; "NCBI or Genbank Accession No.").

In particular, the term "Norovirus protein" as used herein comprises an individual structural or non-structural Norovirus protein. For example, a Norovirus protein in the meaning of the present invention may be a protein selected from the group consisting of Norovirus capsid protein VP1, Norovirus capsid protein VP2, and a Norovirus non-structural protein (NS), such as NS1/NS2, NS3, NS4, NS5, NS6, or NS7.

In particular, the term "Norovirus protein" as used herein is a Norovirus capsid protein VP1. Further, in particular, the term "Norovirus protein" as used herein is a Norovirus capsid protein derived from a GII.4 Norovirus.

As used herein, the term "Norovirus protein" may also refer to an amino acid sequence corresponding to an individual Norovirus protein as present in a Norovirus polyprotein (precursor protein). Said amino acid sequence in the polyprotein may differ from the amino acid sequence of the corresponding amino acid sequence of the respective mature Norovirus protein (i.e. after cleavage/processing the polyprotein). For example, the corresponding amino acid sequence comprised in the polyprotein may comprise amino acid residues that are removed during cleavage/processing of the polyprotein (such as a signal sequence or a target site for a protease) and that are no longer present in the respective mature Norovirus protein. In the context of the present invention, the term "Norovirus protein" comprises both, the precursor amino acid sequence comprised in a Norovirus polyprotein (i.e. as part of a polypeptide chain optionally further comprising other viral proteins) as well as the respective mature individual Norovirus protein. For example, the term "Norovirus capsid protein VP1" as used herein may refer to an amino acid sequence in a Norovirus polyprotein corresponding to the precursor sequence of Norovirus capsid protein VP1 (comprising, for example, a (C-terminal) signal sequence) as present in a Norovirus polyprotein as well as to a mature (separate) Norovirus capsid protein VP1 (no longer comprising, for example, a (C-terminal) signal sequence).

Where reference is made to amino acid residues and their position in a Norovirus protein or in a Norovirus polyprotein, any numbering used herein—unless stated otherwise—relates to the position of the respective amino acid residue in a Norovirus polyprotein (precursor protein), wherein position "1" corresponds to the first amino acid residue, i.e. the amino acid residue at the N-terminus of a Norovirus polyprotein. More preferably, the numbering with regard to amino acid residues refers to the respective position of an amino acid residue in a Norovirus polyprotein, which is preferably derived from a Norovirus strain selected from the group consisting of Genogroup II or Genogroup I (abbreviated as GII, or GI, respectively), more preferably from the group consisting of Genogroup II genotype 4 (abbreviated as GII.4) or Genogroup I genotype 1 (abbreviated as GII.4 and GI.1), or even more preferably the strain is selected from strain Norovirus strain GII.4 CIN-1 or CIN-002.

Preferred Norovirus protein in the context of the invention may be any polypeptide comprising or consisting of an amino acid sequence according to any one of the following amino acid sequences from Genbank, or a fragment or variant of any of these sequences: ACO55068, AFS33552, AFS33555, AFX71665, BAI49904, BAI49914, BAS02083, CRL46958, CRL46973, ADB27027, AGI96397, AGX01095, AGX01098, AKI30060, AGL98413, ACT76145, ACT76148, ACT76151, AED02034, AEX10549, AFJ21448, AFN06726, AFN06727, AFN06731, AFN06732, AFN06733, AFN06735, AFV08771, AFV08777, AFV08795, AFX95940, AFJ99552, AGK25912, AID68581, AII73717, AII73735, AII73741, AII73759, AII73765, AII73780, AII73783, AIS40019, AIY27747, BAG70437, BAU16306 ACY00615, ADK47170, BAQ20801, AAZ31376, ABI97981, ABW74128, ACC69023, ACL27297, ACL27298, ACL27299, ACL31322, ACN32770, ACU156258, ACX85810, AFB18010, AFB18013, AFK75854, AFN61315, AFQ00511, AHC12655, AHZ12912, AIC32559, AID51489, BAF45861, BAF74508, BAF74509, BAF74512, BAF74517, BAF74521, BAF95499, BAF95501, BAF95505, BAG55289, BAG68713, BAG68801, BAH30707, BAL40873, ADB27914, ADT70684, AFJ38516, AFJ38519, AFW15943, AGE99599, AGE99812, AGT17839, AFX71669, AGE99607, AH159166, BAR42290, BAR63722, BAS02084, CRL46953, CRL46962, ABQ63283, ACW19927, ADQ43783, ADV37805, ADV37919, AEI83469, AEQ77282, AFA55174, AFC89656, AFC89665, AFJ04707, AFJ04708, AFJ04709, AFP89593, AFU55731, AFU92710, AGO64038, AGT62521, AJZ77004, AJZ77015, AKE31861, ALD09618, ALT54494, CCX28619, AGC96535, ABY67257, AHA91656, KT315718, KT591501, KT315706, KR921940, KX767083, LC153121, LC175468, KY485125, KU555841, KP784696, KP064099, U70059, X81879.

Preferred examples of Noroviruses which may be used for providing the nucleic acid molecules of the invention may include Norovirus GII.4-031693-USA-2003, Norovirus GII.4/Farmington Hills/2002/USA, Norovirus GII.4-2006b 092895-USA-2008, Norovirus GII.4-GZ2010-L87-Guangzhou-2011, Norovirus GII.4-USA-1997, Norovirus GI.1-USA-1968.

Further Preferred examples of Noroviruses which may be used for providing the nucleic acid molecules of the invention may include Norovirus Hu/GII.4/Dijon/E872/2002/FRA, Norovirus Hu/GII.4/MD120-12/1987/USA, Norovirus Hu/GII.1/7EK/Hawaii/1971/USA, Norovirus Hu/GII.6/CHDC4073/1984/USA, Norovirus Hu/GII.4/Hiroshima/19/2001/JPN, Norovirus Hu/GII.4/Hiroshima/67/2006/JPN, Norovirus Hu/GII/JP/2015/GII.PeGII.4/Osaka/OSF78, Norovirus GII/Hu/NL/2012/GII.4/Groningen, Norovirus GII/Hu/NL/2014/GII.2/Groningen, Norovirus Hu/GII.4/New Orleans1500/2008/USA, Norovirus Hu/GII.6/Ohio/490/2012/USA, Norovirus Hu/GII.3/Jingzhou/2013402/CHN, Norovirus Hu/GII.4/Jingzhou/2013403/CHN, Norovirus Hu/GII.17/Gaithersburg/2014/113, Norovirus Hu/GII.4/C127/GF/1978, Norovirus Hu/GII.4/CHDC3967/1988/US, Norovirus Hu/GII.4/CHDC4108/1987/US, Norovirus Hu/GII.4/CHDC4871/1977/113, Norovirus Hu/GII.3/CHDC5261/1990/US, Norovirus Hu/GII.3/Milwaukee009/2010/USA, Norovirus Hu/GII.4/Miranda/NSW817L/2010/AU, Norovirus Hu/GII.2/KL109/MY/1978, Norovirus Hu/GII.14/HK74/CN/1978, Norovirus Hu/GII.7/HK4/CN/1976, Norovirus Hu/GII.17/C142/GF/1978, Norovirus Hu/GII.5/C15/GF/1978, Norovirus Hu/GI.5/E57/110/1975, Norovirus Hu/GII.4/Randwick/NSW882J/2011/AU, Norovirus Hu/GII.4/Berowra/NSW767L/2012/AU, Norovirus Hu/GII.4/Sydney/NSW0514/2012/AU, Norovirus Hu/GII.4/Hong Kang/CUHK3630/2012/CHN, Norovirus Hu/GII.4/VP1172/Shanghai/2012/CHN, Norovirus Hu/GII-4/New Taipei/CGMH61/2012/TW, Norovirus GII/Hu/HKG/2013/GII.4/CUHK-NS-141, Norovirus GII/Hu/JP/2002/GII.P12_GII.13/Saitama/T80, Norovirus GII/Hu/JP/2001/GII.P12_GII.12/Saitama/T15, Norovirus GII/Hu/JP/2007/GII.P21_GII.21/, Kawasaki/YO284, Norovirus GII/Hu/JP/2007/GII.P15_GII.15/Sapporo/HK299, Norovirus GI/Hu/JP/2007/GI.P3_GI.3/Shimizu/KK2866, Norovirus GII/Hu/JP/2007/GII.P7_GII.14/Fukuoka/KK282, Norovirus GI/Hu/JP/2007/GI.P8_GI.8/Nagoya/KY531, Norovirus Hu/GII.4/SJTLIH1/CHN/2014, Norovirus Hu/GII.4/variant Sydney 2012/FRA, Norovirus Hu/GII-4/Hokkaido4/2006/JP, Norovirus GIV/Hu/Jp/2001/GIV.1/OC01017023, Norovirus Hu/GII.4/Beijing/53671/2007/CHN, Norovirus Hu/II.4/2200661/HK/2010, Norovirus Hu/GII.4/Aichi368-14/2014, Norovirus Hu/GII.4/Hunter 284E/040/All, Norovirus Hu/GII-4/Osaka/1998/JPN, Norovirus Hu/GI.1/P774.Delsjo2004/Gothenburg/Sweden, Norovirus pig/GII.11/F18-10/2005/CAN, Norovirus Hu/GII.4/Wellington/1995/USA, Norovirus Hu/GII.4/Henry/2000/USA, Norovirus Hu/GII.4/SSCS/2005/USA, Norovirus GII/Hu/IN/2006/GII.P4_GII.4_Yerseke2006a/Pune-PC21, Norovirus Hu/GI.1/P7-587/2007/Stromstad/Sweden, Narovirus Hu/GI.2/Leuven/2003/BEL, Norovirus Hu/GII.7/NSW743L/2008/AUS, Norovirus Hu/GII.2/NF2002/USA/2002, Norovirus Hu/GII.4/NF2003/USA/2003, Norovirus Hu/GII.3/1999, Norovirus Hu/GIV.1/Ahrenshoop246/DEU/2012, Norovirus Hu/GII.4/Xi'an/P19/2010/CHN, Norovirus Hu/GII.4/PA363/2011/ITA, Norovirus Hu/GII.4/P3/2012/Gothenburg/Sweden, Norovirus Hu/GII.4/Tanger/TM987/2011/MAR, Norovirus 12-X-2/2012/GII.P22/GII.5, Norovirus Hu/GII.4/Kobe034/2009/JP, Norovirus Hu/GGII.4/Tiel001/1995/NL, Norovirus Hu/GGII.4/DenHaag015/2000/NL, Norovirus Hu/GGII.4/Schiedam018/2001/NL, Norovirus Hu/GGII.4/Apeldoorn023/2003/NL, Norovirus Hu/GGII.4/Middelburg007/2004/NL, Norovirus Hu/GII-4/Matsuda/021071/2002/JP, Norovirus Hu/GII-4/Kaiso/030559/2003/JP, Norovirus Hu/GII-4/Awa/040354/2004/JP, Norovirus Hu/GII.4/Apeldoorn317/2007/NL, Norovirus Hu/GII.2/Rotterdam39E/2002/NL, Norovirus Hu/GII.4/RotterdamP200/2005/NL, Norovirus Hu/GII.4/Stockholm/19865/2008/SE, Norovirus Hu/GII.6/OC04092VLP/2004/JP, Norovirus Hu/GII.4/HS194/2009/US, Norovirus Hu/GII.12/HS210/2010/USA, Norovirus Hu/GI.1/8FIIa/1998/USA, Norovirus Hu/GII.4/CHDC5191/1974/USA, Norovirus Hu/GII.4/N76/2010/HuZhou, Norovirus Hu/GII.9/39c/1976/SEN, Norovirus Hu/GII.4/KL45/1978/MYS, Norovirus Hu/GII.4/NIHIC17.5/2012/USA, Norovirus Hu/GII.4/NIHIC9/2011/USA, Norovirus Hu/GII.4/C110/1978/GUF, Norovirus Hu/GII.4/HS66/2001/USA, Norovirus Hu/GII/JP/2015/GII.P17_GII.17/Kawasaki308, Norovirus Hu/GII/JP/2014/GII.P17_GII.17/Nagano8-1, Norovirus Hu/GII/JP/2015/GII.Pe_GII.4/Dsaka/OSF78, Norovirus GI/Hu/NL/2011/GI.4/Groningen, Norovirus GII/Hu/NL/2014/GII.4/Groningen01, Norovirus Hu/GII.4/Kenepuru/NZ327/2006/NZL, Norovirus Hu/GII.4/Rathmines/NSW287R/2007/AUS, Norovirus Hu/GII.4/Turramurra/NSW892U/2009/AUS, Norovirus Hu/GII.4/Seoul/0389/2009/KOR, Norovirus Hu/GII.4/Seoul/0945/2009/KOR, Norovirus Hu/GII.12/Shelby/2009/USA, Norovirus Hu/GI.7/TCH-060/USA/2003, Norovirus Hu/GII.1/Ascension208/2010/USA, Norovirus Hu/GII.13/VA173/2010/USA, Norovirus Hu/GII.21/Salisbury150/2011/USA, Norovirus Hu/GII.4/1997/USA, Norovirus Hu/GII.4/Farmington Hills/2004/USA, Norovirus Hu/GII.4/Minerva/2009/USA, Norovirus Hu/GII.4/Ohio/71/2012/USA, Norovirus Hu/GII.4/AlbertaEl095/2011/CA, Norovirus Hu/GII.4/SG4051-09/2009/SG, Norovirus Hu/GII.3/TCH-104/USA/2002, Norovirus Hu/GINTCH-099/USA/2003, Norovirus 06-AM-11/2009/GII.4/Yerseke/2006a, Norovirus 09-BI-2/2009/GII.4/NewOrleans/2009, Norovirus Hu/GII.4/PR328/2013/ITA, Norovirus Hu/GII.P17_GII.17/PR668/2015/ITA, Norovirus Hu/GII.4/AlbertaSPI/2013/CA, Norovirus Hu/GII.4/C00007892/2011/UK, Norovirus Hu/GII.6/GZ2010-L96/Guangzhou/CHN/2011, Norovirus Bo/GIII.1/Aba-Z5/2002/HUN, Norovirus GI.9, Norovirus Hu/GII.17/CUHK-NS-670/HKG/2015, Norovirus GII/Hu/SI/2015/GII.17/Ljubljana1662, Norovirus Hu/GII.17/CUHK-NS-947/HKG/2015, Norovirus Hu/GII.21/CUHK-NS-909/HKG/2015, Norovirus Hu/GII.4/Melbourne6623/2016/AUS, Norovirus GII/Hu/JP/2016/GII.P16_GII.4_Sydney2012/OH16002, Norovirus Hu/GII/JP/2016/GII.P16_GII.4_Sydney2012/Kawasaki194, Norovirus 16F2149_GII.2_Guangdong_CHN_2016, Norovirus Hu/GII.17/CHK-NS-864/HKG/2016, Norovirus GII/Hu/ZAF/2012/GII.P4_GII.4/CapeTown/9772, Norovirus GII.12, Snow Mountain virus, Human calicivirus strain Melksham.

Preferred examples of Noroviruses which may be used for providing the nucleic acid molecules of the invention are provided in Table 1 (Column 6 "Strain/Isolate"). Even more preferred examples of Noroviruses which may be used for providing the nucleic acid molecules of the invention are provided in Table 3 (Column 1"Strain/Isolate").

The nucleic acid and corresponding amino acid sequences of each are all incorporated by reference in their entirety. In same embodiments, a cryptogram can be used for identification purposes and is organized: host species from which the virus was isolated/genus abbreviation/species abbreviation/strain name/year of occurrence/country of origin.

(Green et al., Human Caliciviruses, in Fields Virology Vol. 1 841-874 (Knipe and Howley, editors-in-chief, 4th ed., Lippincott Williams 6. Wilkins 2000). Use of a combination of Norovirus genogroups such as a genogroup I.1 (Norwalk virus) and 11.4 (f.e. Houston virus) or other commonly circulating strains, or synthetic constructs representing combinations or portions thereof are preferred in some embodiments. New strains of Noroviruses are routinely identified (Centers for Disease Control, Morbidity and Mortality Weekly Report, 56(33):842-846 (2007)) and consensus sequences of two or more viral strains may also be used to express Norovirus antigens.

In some embodiments described herein, the at least one polypeptide encoded by the at least one coding region of the artificial nucleic acid may consist of an individual Norovirus protein, the amino acid sequence of which does typically not comprise an N-terminal methionine residue. It is thus understood that the phrase "polypeptide consisting of Norovirus protein . . . " relates to a polypeptide comprising the amino acid sequence of said Norovirus protein and—if the amino acid sequence of the respective Norovirus protein does not comprise such an N-terminal methionine residue—an N-terminal methionine residue.

Norovirus Sequences:

According to a preferred embodiment, the inventive artificial nucleic acid comprises at least one coding region encoding at least one polypeptide comprising or consisting of at least one Norovirus protein as described herein, wherein the at least one Norovirus protein comprises an amino acid sequence according to any one of SEQ ID NOs: 1-4410, or a fragment or variant of any of these sequences.

In one embodiment, the term "sequence", "sequence of the invention", "artificial nucleic acid" or "artificial nucleic acid of the invention" refers to any one of SEQ ID NOs: 1-39590, 39713-39746.

In a further embodiment, the artificial nucleic acid of the invention comprises at least one encoded polypeptide comprising (i) at least one of the amino acid sequences according to any one of SEEM NOs: 1-4410; and/or (ii) at least one of the amino acid sequences having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NOs: 1-4410; and/or (iii) an orthologue or a paralogue of any one of SEQ ID NOs: 1-39690, 39713-39746; and/or a fragment or variant of any of these sequences.

In another embodiment the artificial nucleic acid of the invention comprises at least one coding region comprising (i) at least one of the nucleic acid sequences according to any one of SEQ ID NOs: 4411-39990, 39713-39749; and/or (ii) at least one of the nucleic acid sequences having, in increasing order of preference, at least 50%, 51%, 52%, 53%, 54%, 55%, 56%, 57%, 58%, 59%, 60%, 91%, 62%, 63%, 64%, 95%, 66%, 97%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the nucleic acid sequence represented by any one of SEQ ID NOs: 4411-39890, 39713-39748; and/or (iii) at least one complement of the nucleic acid sequences which are capable of hybridizing with a nucleic acid sequence comprising a sequence as shown in SEQ ID NOs: 4411-39690, 39713-39748, and/or to a nucleic acid encoding a polypeptide having a sequence as shown in SEQ ID NOs: 1-4410, and/or (iv) an orthologue or a paralogue of any one of SEQ ID NOs: 1-39890, 39713-39746; and/or a fragment or variant of any of these sequences.

In the context of the present invention a fragment of a protein or a variant thereof encoded by the at least one coding sequence of the artificial nucleic acid according to the invention may typically comprise an amino acid sequence having a sequence identity of at least 5%, 10%, 20%, 30%, 40%, 50%, 80%, 70%, 80%, 85%, 88%, 87%, 88%, 89%, 90%, 91%, 92%, 93%, 94%, 95%, 99%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring full-length protein or a variant thereof, preferably as disclosed in Table 1, column 1, column 2 or column 3, more preferably as disclosed in Table 3, column 1, column 2, column 3.

In a preferred embodiment, the at least one coding sequence of the artificial nucleic acid sequence according to the invention preferably encodes Norovirus proteins selected from the proteins provided in Table 1, or a fragment or variant thereof. Any Norovirus protein provided in Table 1, or any a fragment or variant thereof, can cause an immune response when administered to an individual. Therefore, all Norovirus proteins provided in Table 1 and Table 3 can be considered as preferred Norovirus antigens in the context of the present invention.

It is further preferred that the at least one coding sequence of the artificial nucleic acid sequence of the present invention encodes a Norovirus protein or peptide, or a fragment or variant thereof, wherein the Norovirus protein or peptide is an antigen selected from the antigens listed in Table 1. Therein, each row (row 1-row 4410) corresponds to a Norovirus protein or antigen as identified by the respective gene name (first column, column 1 "Name") and the database accession number of the corresponding protein (second column, column 2 "NCBI or Genbank Accession No."). The third column, column 3 ("A") in Table 1 indicates the SEQ ID NOs corresponding to the respective amino acid sequence as provided herein. The SEQ ID Hs corresponding to the nucleic acid sequence of the wild type nucleic acid sequence encoding the Norovirus protein or peptide is indicated in the fourth column, column 4 ("B"). The fifth column, column 5 ("C") provides the SEQ ID NOs corresponding to modified nucleic acid sequences of the nucleic acid sequences as described herein that encode the Norovirus protein or peptide preferably having the amino acid sequence as defined by the SEQ ID NOs indicated in the third column ("A") or by the database entry indicated in the second column ("NCBI or Genbank Accession No.").

In this context it is further preferred that the at least one coding sequence of the artificial nucleic acid sequence of the present invention encodes at least one Norovirus protein or peptide which is derived from Norovirus polyprotein, or a fragment or variant thereof, wherein the Norovirus polyprotein is selected from the Norovirus polyprotein amino acid sequences listed in Table 1. Therein, each row corresponds to a Norovirus polyprotein as identified by the respective gene name (first column "Name", derived from NCBI or Genbank) and the database accession number of the corresponding protein (second column "NCBI or Genbank Accession No."). The third column ("A") in Table 1 indicates the SEQ ID NOs corresponding to the respective amino acid sequence as provided herein. The SEQ ID NOs corresponding to the nucleic acid sequence of the wild type nucleic acid encoding the Norovirus protein or peptide is indicated in the fourth column ("B"). The fifth column ("C") provides the SEQ ID NOs corresponding to modified nucleic acid sequences of the nucleic acids as described herein that encode the Norovirus protein or peptide preferably having the amino acid sequence as defined by the SEQ ID NOs indicated in the third column ("A") or by the database entry indicated in the second column ("NCBI or Genbank Accession No.").

Particularly preferred in this context are the Norovirus polyprotein and nucleic acid sequences according to SEQ ID NOs: 39713-39746.

In specific embodiments the Norovirus protein or peptide is derived from a Norovirus capsid protein VP1 according to SEQ ID NOs: 1-4410.

In this context it is further preferred that the at least one coding sequence of the artificial nucleic acid sequence of the present invention encodes at least one Norovirus protein or peptide which is derived from Norovirus capsid protein VP1, or a fragment or variant thereof, wherein the Norovirus capsid protein VP1 is selected from the Norovirus capsid protein VP1 amino acid sequences listed in Table 1. Therein, each row corresponds to a Norovirus capsid protein VP1 as identified by the respective gene name (first column "Name") and the database accession number of the corresponding protein (second column "NCBI or Genbank Accession No"). The third column ("A") in Table 1 indicates the SEQ ID NOs corresponding to the respective amino acid sequence as provided herein. The SEQ ID NOs corresponding to the nucleic acid sequence of the wild type RNA encoding the Norovirus antigen is indicated in the fourth column ("B"). The fifth column ("C") provides the SEQ ID NOs corresponding to modified nucleic acid sequences of the RNAs as described herein that encode the Norovirus antigen preferably having the amino acid sequence as defined by the SEQ ID NOs indicated in the third column ("A") or by the database entry indicated in the second column ("NCBI or Genbank Accession No").

According to a preferred embodiment, the inventive artificial nucleic acid comprises or consists of at least one coding sequence encoding at least one Norovirus protein or peptide as described herein. Preferably, the inventive artificial nucleic acid comprises or consists of a coding sequence according to any one of SEQ ID NOs: 4411-39690, 39713-39746, or a homolog, fragment or variant of any of these sequences (see Table 1, column "B" and "C").

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the methods of the present invention. The nucleic acid molecule is preferably at least 20, 30, 50, 100, 250 or more nucleotides in length.

In a preferred embodiment, the present invention thus provides artificial nucleic acid sequences comprising at least one coding sequence, wherein the coding sequence encoding Norovirus capsid protein VP1 comprises or consists any one of the nucleic acid sequences defined in Table 1, preferably in the fourth or fifth column (column "B" or "C", respectively) of Table 1, or a fragment or variant of any one of these sequences.

In particularly preferred embodiments the nucleic acid sequence comprises or consists of at least one coding sequence encoding Norovirus capsid protein VP1 according to SEQ ID NOs: 4411-39690, 39713-39746.

In these context it is particularly preferred that the nucleic acid sequence according to the invention comprises at least one coding sequence encoding Norovirus capsid protein VP1 comprising a nucleic acid sequence selected from sequences being identical or at least 50%, 60%, 70%, 80%, 85%, 88%, 87%, 88%, 89%, 90%, 91%, 92%, 93%, 94%, 95%, 96%, 97%, 98%, or 99% identical to the nucleic acid sequences as disclosed in Table 1, preferably in the fourth or fifth column (column "B" or "C", respectively) of Table 1 or a fragment or variant thereof.

According to a particularly preferred embodiment, the present invention provides an nucleic acid sequence as defined herein comprising at least one coding sequence encoding at least one Norovirus peptide or protein derived from Norovirus capsid protein VP1, wherein the coding sequence comprises or consists of any one of the (modified) nucleic acid sequences defined in the Column "C" of Table 1, or of a fragment or variant of any one of these sequences.

According to a preferred embodiment, the inventive artificial nucleic acid comprises or consists of at least one coding sequence encoding at least one Norovirus protein or peptide as described herein, wherein the at least one Norovirus protein comprises an amino acid sequence according to any one of SEQ ID NOs: 1-4410, or a homolog, fragment or variant of any of these sequences (see Table 1, third column, column "A"). According to a preferred embodiment, the inventive artificial nucleic acid comprises at least one coding sequence encoding at least one protein or peptide derived from a Norovirus, or a fragment or variant thereof, wherein the Norovirus protein or peptide preferably comprises or consists of any one of the amino acid sequences defined in the third column (column "A") of Table 1, or a fragment or variant of any one of these sequences. In other words, the at least one coding sequence preferably encodes a Norovirus protein comprising or consisting of an amino acid sequence selected from the group consisting of SEQ ID NOs: 1-4410.

In a further preferred embodiment, the at least one coding sequence of the nucleic acid sequence according to the invention comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (G/C modified) RNA sequences defined in the fifth column (column "C") of Table 1, or of a fragment or variant of any one of these sequences.

In a further preferred embodiment, the at least one coding sequence of the nucleic acid sequence according to the invention comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (human codon usage adapted) RNA sequences defined in the fifth column (column "C") of Table 1, or of a fragment or variant of any one of these sequences.

According to a particularly preferred embodiment, the at least one coding sequence of the RNA sequence according to the invention comprises or consists of an nucleic acid sequence having a sequence identity of at least 80% with any one of the (human codon usage adapted) RNA sequences defined in the fifth column (column "C") of Tables 1, or of a fragment or variant of any one of these sequences.

According to a particularly preferred embodiment, the present invention provides an nucleic acid sequence as defined herein comprising at least one coding sequence encoding at least one Norovirus peptide or protein derived from Norovirus capsid protein VP1, wherein the coding sequence comprises or consists of any one of the (human codon usage adapted) RNA sequences defined in the fifth column (column "C") of Table 1, or of a fragment or variant of any one of these sequences.

Norovirus peptide or protein derived from Norovirus capsid protein VP1, wherein the coding sequence comprises or consists of any one of the (codon optimized) RNA sequences defined in the fifth column (column "C") of Table 1, or of a fragment or variant of any one of these sequences.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the methods of the present invention, e.g. comprising the sequence shown in SEQ ID NOs: 4411-39690, 39713-39746. The nucleic acid molecule is preferably at least 20, 30, 50, 100, 250 or more nucleotides in length.

In one embodiment of the invention, a complement sequence derived from SEQ ID NOs: 4411-39690, 39713-39746, or a fragment or variant thereof is used in the hybridization. Preferably, a complement of a nucleic acid molecule of the invention that hybridizes under stringent conditions to a sequence shown in SEQ ID NOs: 4411-39690, 39713-39749 correspond to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein).

In a further preferred embodiment, the at least one coding sequence of the nucleic acid sequence according to the invention comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (codon optimized) RNA sequences defined in the fifth column 5 (column "C") of Table 1, or of a fragment or variant of any one of these sequences.

In the context of the present invention, a "fragment" of an amino acid sequence, such as a polypeptide or a protein, e.g. the at least one Norovirus protein as described herein, may typically comprise a sequence of a protein or peptide as defined herein, which is, with regard to its amino acid sequence (or the respective coding nucleic acid molecule), N-terminally and/or C-terminally truncated compared to the amino acid sequence of the original (native) protein (or respective coding nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide.

Preferably, a fragment of an amino acid sequence comprises or consists of a continuous stretch of amino acid residues corresponding to a continuous stretch of amino acid residues in the protein the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) protein, from which the fragment is derived.

In the context of the present invention, a fragment of a protein or of a peptide may furthermore comprise a sequence of a protein or peptide as defined herein, which has a length of for example at least 5 amino acids, preferably a length of at least 6 amino acids, preferably at least 7 amino acids, more preferably at least 8 amino acids, even more preferably at least 9 amino acids; even more preferably at least 10 amino acids; even more preferably at least 11 amino acids; even more preferably at least 12 amino acids; even more preferably at least 13 amino acids; even more preferably at least 14 amino acids; even more preferably at least 15 amino acids; even more preferably at least 16 amino acids; even more preferably at least 17 amino acids; even more preferably at least 18 amino acids; even more preferably at least 19 amino acids; even more preferably at least 20 amino acids; even more preferably at least 25 amino acids; even more preferably at least 30 amino acids; even more preferably at least 35 amino acids; even more preferably at least 50 amino acids; or most preferably at least 100 amino acids. For example such fragment may have a length of about 6 to about 20 or even more amino acids, e.g. fragments as processed and presented by MHC class 1 molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even mare amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

As used herein, a "variant" of a protein or a peptide may be generated, having an amino acid sequence, which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (urry, 1985, Absorption, Circular Dichroism and ORD of Polypeptides, in: Modern Physical Methods in Biochemistry, Neuberger et al. (ed.), Elsevier, Amsterdam).

In the context of the present invention, a "variant" of a protein or peptide may have at least 50%, 51%, 52%, 53%, 54%, 55%, 56%, 57%, 58%, 59%, 60%, 61%, 92%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% amino acid identity over a stretch of at least 10, at least 20, at least 30, at least 50, at least 75 or at least 100 amino acids of such protein or peptide. More preferably, a "variant" of a protein or peptide as used herein is at least 40%, preferably at least 50%, more preferably at least 60%, more preferably at least 70%, even more preferably at least 80%, even more preferably at least 90%, most preferably at least 95% identical to the protein or peptide, from which the variant is derived.

Alternatively or additionally, a protein of the invention, a capsid protein, a Norovirus capsid protein VP1 or a Norovirus capsid protein VP2 as defined herein refers to any polypeptide being identical or having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more amino acid sequence identity to the protein of the invention, a capsid protein, a Norovirus capsid protein VP1 or a Norovirus capsid protein VP2 as represented by SEQ ID NOs: 1-4410, or to any of the full length polypeptide sequences given in SEQ ID NOs: 1-4410.

Furthermore, variants of proteins or peptides as defined herein, which may be encoded by a nucleic acid, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence in one or more mutation(s) within the above meaning.

According to a preferred embodiment, the at least one coding region of the inventive artificial nucleic acid comprises or consists of at least one nucleic acid sequence according to any one of SEQ ID NOs: 4411-39690, 39713-39746, or a fragment or variant of any of these sequences.

As used herein, a "fragment" of a nucleic acid sequence comprises or consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. Such a fragment, in the sense of the present invention, is preferably a functional fragment of the full-length nucleic acid sequence.

In the context of the present invention, the phrase "variant of a nucleic acid sequence" typically relates to a variant of a nucleic acid sequence, which forms the basis of a nucleic acid sequence. For example, a variant nucleic acid sequence may exhibit one or more nucleotide deletions, insertions, additions and/or substitutions compared to the nucleic acid sequence, from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% nucleotide identity over a stretch of at least 10, at least 20, at least 30, at least 50, at least 75 or at least 100 nucleotides of such nucleic acid sequence.

Alternatively or additionally, a nucleic acid sequence encoding a protein of the invention, a capsid protein, a Norovirus capsid protein VP1 or a Norovirus capsid protein VP2 as defined herein refers to any nucleic acid sequence having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the nucleic acid sequence as represented by SEQ ID NOs: 4411-39690, 39713-39746, or to any of the full length polypeptide sequences given in SEQ ID NOs: 1-4410.

Preferably, the at least one polypeptide encoded by the at least one coding region of the inventive artificial nucleic acid comprises or consists of Norovirus capsid protein VP1, or a fragment or variant thereof. More preferably, the at least one encoded polypeptide comprises or consists of an amino acid sequence according to any one of SEQ ID NOs: 1-4410, or a fragment or variant of any of these sequences.

Alternatively or additionally, a nucleic acid sequence encoding a Norovirus capsid protein VP1 as defined herein refers to any nucleic acid sequence being identical or having in increasing order of preference at least 50%, 51%, 52%, 53%. 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%. 98%, or 99% or more sequence identity to the full-length nucleic acid sequence as represented by SEQ ID NOs: 4411-39690, 39713-39746.

In certain embodiments, the at least one encoded polypeptide comprises or consists of a fragment of Norovirus capsid protein VP1 or a variant of such a fragment. Preferably, the at least one encoded polypeptide comprises or consists of a C-terminal fragment of Norovirus capsid protein VP1, or a variant of such a fragment. In another embodiment, the at least one encoded polypeptide comprises or consists of an N-terminal fragment of Norovirus capsid protein VP1, or a variant of such a fragment.

Preferably, the at least one encoded polypeptide comprises or consists of a fragment, preferably a C-terminal fragment, or a variant of such a fragment, of a Norovirus capsid protein VP1 as present in a Norovirus polyprotein (precursor protein) before cleavage. In the context of the present invention, the phrase "Norovirus capsid protein VP1 as present in a Norovirus polyprotein before cleavage" typically refers to a continuous amino acid sequence beginning at the N-terminus of a Norovirus polyprotein (before cleavage) and comprising the amino acid residue immediately N-terminal of the first amino acid residue of a precursor of Norovirus pr protein as present in the Norovirus polyprotein. In other words, the phrase "Norovirus capsid protein VP1 as present in a Norovirus polyprotein before cleavage" may refer to a part of a Norovirus polyprotein corresponding to Norovirus capsid protein VP1 comprising a C-terminal fragment, preferably a C-terminal signal sequence, which is typically not present in mature Norovirus protein VP1. For example, a 'Norovirus capsid protein VP1 as present in a Norovirus polyprotein before cleavage' as used herein may comprise an amino acid sequence derived from an amino acid sequence corresponding to amino acid residues 1 to 122 of a Norovirus polyprotein before cleavage. According to a preferred embodiment, a Norovirus capsid protein VP1 as present in a Norovirus polyprotein before cleavage comprises an amino acid sequence according to any one of SEQ ID NOs: 1-4410, or a fragment or variant of any of these sequences.

Hence, a "C-terminal fragment, or a variant of such a fragment, of Norovirus capsid protein VP1 as present in a Norovirus polyprotein (precursor protein) before cleavage" preferably comprises an amino acid sequence corresponding to a continuous amino acid sequence, which is located immediately N-terminal of Norovirus pr protein in a Norovirus polyprotein before cleavage, or to a fragment or variant of said amino acid sequence. Preferably, the C-terminal fragment, or a variant of such a fragment, of Norovirus capsid protein VP1 as present in a Norovirus polyprotein (precursor protein) before cleavage comprises or consists of at least 3, 4, 5, 8, 7, 8, 9, or, most preferably, at least 10 amino acid residues. Alternatively, the C-terminal fragment, or a variant of such a fragment, of Norovirus capsid protein VP1 as present in a Norovirus polyprotein (precursor protein) before cleavage may consist of 3 to 40, 3 to 30, 3 to 20, 5 to 20 or 10 to 20 amino acid residues.

According to a preferred embodiment, the at least one polypeptide encoded by the at least one coding region of the inventive artificial nucleic acid comprises or consists of at least one amino acid sequence derived from a signal sequence, or a fragment or variant thereof.

As used herein, the term "signal sequence" preferably refers to an amino acid sequence, which is involved in the targeting of a protein, e.g. a Norovirus protein, to a cellular compartment, preferably a membrane, more preferably a membrane of the endoplasmic reticulum (ER). A signal sequence in the context of the present invention preferably comprises from 3 to 40, 3 to 30, 3 to 20, 5 to 20 or 10 to 20 amino acid residues. Such a signal sequence may be present, for example, in a Norovirus polyprotein and may be removed during processing of said polyprotein. A signal sequence is preferably no longer present in a mature Norovirus protein. For example, Norovirus capsid protein VP1 as present in a Norovirus polyprotein typically comprises a C-terminal signal sequence, corresponding to the amino acid sequence immediately N-terminal of Norovirus pr protein (e.g. amino acid residues 105 to 122 in a Norovirus polyprotein before cleavage). That signal sequence is involved in targeting Norovirus capsid protein VP1 to the ER membrane and is typically removed in order to yield mature Norovirus capsid protein VP1, which no longer comprises said C-terminal fragment comprising a signal sequence.

Preferably, the amino acid sequence derived from a signal sequence, or a fragment or variant thereof, comprises at least 3, 4, 5, 8, 7, 8, 9, 10, 11, 12, 13, 14, 15, 18, 17, 18, 19 or at least 20 amino acid residues. Alternatively, the amino acid sequence derived from a signal sequence, or a fragment or variant thereof may consist of 3 to 40, 3 to 30, 3 to 20, 5 to 20 or 10 to 20 amino acid residues. Most preferably, the amino acid sequence derived from a signal sequence, or a fragment or variant thereof consists of from 3 to 20 amino acid residues.

In a preferred embodiment, the at least one polypeptide encoded by the at least one coding region of the inventive artificial nucleic acid comprises or consists of at least one amino acid sequence derived from a signal sequence, which comprises or consists of an amino acid sequence that is bound by signal recognition particle (SRP). More preferably, the at least one amino acid sequence derived from a signal sequence comprises or consists of an amino acid sequence that is recognized by signal peptide peptidase (SPP), by a viral protease and/or by furin or a furin-like protease. Most preferably, the at least one amino acid sequence derived from a signal sequence comprises an amino acid sequence that is recognized by a viral protease comprising one or more of a Norovirus non-structural protein selected from the group consisting of NS1/NS2, NS3, NS4, NS5, NS6, and NS7.

In a preferred embodiment, the at least one polypeptide encoded by the at least one coding region of the inventive artificial nucleic acid comprises or consists of at least one amino acid sequence derived from a signal sequence of a secretory protein or from a signal sequence of a membrane protein. More preferably, the at least one amino acid sequence derived from a signal sequence, preferably derived from a signal sequence of a membrane protein, targets the at least one encoded protein to a cellular compartment, preferably to the endoplasmic reticulum (ER), more preferably to the ER membrane.

It is further preferred that the at least one polypeptide encoded by the at least one coding region of the inventive artificial nucleic acid comprises or consists of an amino acid sequence corresponding to a signal sequence from a Norovirus protein, preferably from Norovirus capsid protein VP1, more preferably from Norovirus capsid protein VP1 as present in a Norovirus polyprotein before cleavage, or a fragment or variant of any of these.

According to a preferred embodiment, the at least one polypeptide encoded by the at least one coding region of the inventive artificial nucleic acid comprises or consists of an amino acid sequence corresponding to a signal sequence from Norovirus capsid protein VP1 as present in a Norovirus polyprotein before cleavage, or a fragment or variant thereof, wherein the signal sequence is preferably derived from a C-terminal fragment of Norovirus capsid protein VP1 as present in a Norovirus polyprotein before cleavage, preferably as described herein.

According to another preferred embodiment, the at least one polypeptide encoded by the at least one coding region of the inventive artificial nucleic acid comprises or consists of a fragment, preferably a C-terminal fragment, or a variant of such a fragment, of a mature Norovirus protein, preferably of a mature Norovirus capsid protein VP1. In this context, it is preferred that the mature Norovirus protein is a mature Norovirus protein as defined herein.

According to a preferred embodiment, the at least one polypeptide encoded by the at least one coding region of the inventive artificial nucleic acid comprises or consists of a fragment, preferably a C-terminal fragment, or a variant of such a fragment, of mature Norovirus capsid protein VP1, wherein the mature Norovirus capsid protein VP1 does preferably not comprise a C-terminal signal sequence as described herein with respect to a Norovirus capsid protein VP1 as present in a Norovirus polyprotein (before cleavage). More preferably, the mature Norovirus capsid protein VP1 comprises or consists of an amino acid sequence according to any one of SEQ ID NOs: 1-4410, or a fragment or variant thereof.

Preferably, the at least one polypeptide encoded by the at least one coding region of the inventive artificial nucleic acid comprises or consists of a C-terminal fragment, preferably as defined herein, or a variant of such a fragment, of mature Norovirus capsid protein VP1.

Preferably, the C-terminal fragment, or a variant of such a fragment, of mature Norovirus capsid protein VP1 comprises or consists of at least 3, 4, 5, 8, 7, 8, 9, or, most preferably, at least 10 amino acid residues. Alternatively, the C-terminal fragment, or a variant of such a fragment, of mature Norovirus capsid protein VP1 may comprise or consist of 3 to 40, 3 to 30, 3 to 20, 3 to 10, 5 to 20 or 10 to 20 amino acid residues.

According to another embodiment, the at least one polypeptide encoded by the at least one coding region of the inventive artificial nucleic acid comprises or consists of an amino acid sequence derived from a a) a C-terminal fragment, or a variant of such a fragment, of a mature Norovirus capsid protein VP1, preferably as defined herein and b) a C-terminal fragment, or a variant of such a fragment, of Norovirus capsid protein VP1 as present in a Norovirus polyprotein (precursor protein) before cleavage, preferably as defined herein; or a signal sequence, or a fragment or variant thereof, preferably as defined herein.

Therein, the amino acid sequence according to a) may be in continuation with the amino acid sequence according to b), wherein the sequences may be positioned relative to each other in any manner. Alternatively, the amino acid sequences according to a) and b) may be separated in the at least one encoded protein by another amino acid sequence. Most preferably, the amino acid sequence according to a) is located N-terminally with respect to b).

According to a preferred embodiment, the at least one polypeptide encoded by the at least one coding region of the inventive artificial nucleic acid comprises or consists of at least one amino acid sequence corresponding to a fragment of Norovirus non-structural protein 1 (NS1/2), or a variant of such a fragment.

As used herein, the term "fragment of Norovirus non-structural protein 1 (NS1/2)" preferably relates to a continuous amino acid sequence derived from Norovirus non-structural protein 1 (NS1/2), or to a fragment or variant of said continuous amino acid sequence.

Preferably, the fragment, or variant thereof, of Norovirus non-structural protein 1 (NS1/2) comprises or consists of at least 3, 4, 5, 8, 7, 8, 9, or, most preferably, at least 10 amino acid residues. Alternatively, the fragment, or variant thereof, of Norovirus non-structural protein 1 (NS1/2) may comprise or consist of 3 to 40, 3 to 30, 3 to 20, 3 to 10, 5 to 20 or 10 to 20 amino acid residues. Most preferably, the fragment, or variant thereof, of Norovirus non-structural protein 1 (NS1/2) comprises or consists of from 3 to 20 amino acid residues.

In a preferred embodiment, the at least one polypeptide encoded by the at least one coding region of the inventive artificial nucleic acid comprises or consists of at least one amino acid sequence corresponding to an N-terminal fragment of Norovirus non-structural protein 1 (NS1/2), or a variant of said fragment.

In the context of the present invention, the term "N-terminal fragment of Norovirus non-structural protein 1 (NS1/2)" relates to a continuous amino acid sequence derived from the N-terminus of Norovirus non-structural protein 1 (NS1/2). More preferably, the N-terminal fragment of Norovirus non-structural protein 1 (NS1/2) comprises or consists of from 3 to 20 amino acid residues. In a preferred embodiment, the at least one encoded polypeptide comprises an N-terminal fragment of Norovirus non-structural protein 1 (NS1/2), wherein the N-terminal fragment of Norovirus non-structural protein 1 (NS1/2) is a continuous amino acid sequence comprising or consisting of 3 to 20 amino acid residues corresponding to a continuous amino acid sequence of 3 to 20 amino acid residues in the first 20 amino acid residues (counting from the N-terminus) of Norovirus non-structural protein 1 (NS1/2), or a variant thereof.

In one embodiment, the at least one encoded polypeptide comprises or consists of an N-terminal fragment of Norovirus non-structural protein 1 (NS1/2), wherein the N-terminal fragment of Norovirus non-structural protein 1 (NS1/2) is a continuous amino acid sequence comprising or consisting of 3 to 20 amino acid residues corresponding to a continuous amino acid sequence of 3 to 20 amino acid residues in the first 20 amino acid residues (counting from the N-terminus) of a mature Norovirus non-structural protein 1 (NS1/2), or a variant thereof. Therein, the first 20 amino acid residues of a mature Norovirus non-structural protein 1 (NS1/2) preferably comprise or consist of the N-terminus itself (i.e. the amino acid residue at the N-terminus) and the 19 following amino acid residues.

In a preferred embodiment, the at least one polypeptide encoded by the at least one coding region of the inventive artificial nucleic acid comprises a first Norovirus protein, which is preferably a Norovirus protein as described herein, or a fragment or variant thereof, and further comprises at least one second or further Norovirus protein, or a fragment or variant thereof, wherein the at least one second or further Norovirus protein, or the fragment or variant thereof, is distinct from the first Norovirus protein, or the fragment or variant thereof.

In that embodiment, the first Norovirus protein is preferably selected from the group consisting of Norovirus NS1/NS2, NS32A, NS428, NS53, NS64A, NS4B or NS75, or a fragment or variant thereof. Preferably, the second or further Norovirus protein is selected from the group consisting of Norovirus capsid protein VP1, Norovirus capsid protein VP2 and a Norovirus non-structural protein, preferably Norovirus NS1/NS2, NS3, NS4, NS5, NS6, or NS7, or a fragment or variant thereof.

More preferably, the at least one polypeptide encoded by the at least one coding region of the inventive artificial nucleic acid comprises Norovirus capsid protein VP1 and/or VP2, or a fragment or variant thereof, and further comprises at least one of the following:

a) an amino acid sequence corresponding to a C-terminal fragment, or a variant thereof, of mature Norovirus capsid protein VP1, preferably as described herein;
b) an amino acid sequence corresponding to a C-terminal fragment, or a variant thereof, of Norovirus capsid protein VP1 as present in Norovirus polyprotein before cleavage, preferably as described herein;
c) an amino acid sequence corresponding to an N-terminal fragment, or a variant thereof, of Norovirus non-structural protein 1 (NS1/NS2), preferably as described herein; and/or
d) an amino acid corresponding to a fragment of Norovirus NS1/NS2, NS3, NS4, NS5, NS6, or NS7.

In a further embodiment, the at least one polypeptide encoded by the at least one coding region of the inventive artificial nucleic acid comprises or consists of, preferably in this order from N-terminus to C-terminus, Norovirus capsid protein VP1, or a fragment or variant thereof,
and Norovirus non-structural protein 1 (NS1/NS2), or a fragment or variant thereof.

According to a preferred embodiment, the inventive artificial nucleic acid is monocistronic, bicistronic or multicistronic.

Preferably, the inventive artificial nucleic acid is monocistronic. In that embodiment, the inventive artificial nucleic acid comprises one coding region, wherein the coding region encodes a polypeptide comprising at least two different Norovirus proteins, preferably as defined herein, or a fragment or variant thereof.

Alternatively, the inventive artificial nucleic acid can be bi- or multicistronic and comprises at least two coding regions, wherein the at least two coding regions encode at least two polypeptides, wherein each of the at least two polypeptides comprises at least one different Norovirus protein, preferably as described herein, or a fragment or variant of any one of these proteins. For example, the inventive artificial nucleic acid may comprise two coding regions, wherein the first coding region encodes a first polypeptide comprising a first Norovirus protein, or a fragment or variant thereof, and wherein the second coding region encodes a second polypeptide comprising a second Norovirus protein, or a fragment or variant thereof, wherein the first and second Norovirus proteins or a fragment or variant thereof are distinct from each other.

The inventive artificial nucleic acid may be provided as DNA or as RNA, preferably an RNA as defined herein. More preferably, the inventive artificial nucleic acid is an artificial mRNA.

The inventive artificial nucleic acid may further be single stranded or double stranded. When provided as a double stranded nucleic acid, the inventive artificial nucleic acid preferably comprises a sense and a corresponding antisense strand.

Preferably, the inventive artificial nucleic acid as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

Nucleic Acid Modifications:

According to one embodiment, the inventive artificial nucleic acid as defined herein, may be in the form of a modified nucleic acid, preferably a modified mRNA, wherein any modification, as defined herein, may be introduced into the inventive artificial nucleic acid. Modifications as defined herein preferably lead to a stabilized artificial nucleic acid, preferably a stabilized artificial RNA, of the present invention.

According to one embodiment, the inventive artificial nucleic acid, preferably an mRNA, may thus be provided as a "stabilized nucleic acid", preferably as a "stabilized mRNA", that is to say as a nucleic acid, preferably an mRNA, that is essentially resistant to in vivo degradation (e.g. by an exo- or endo-nuclease). Such stabilization can be effected, for example, by a modified phosphate backbone of an artificial mRNA of the present invention. A backbone modification in connection with the present invention is a modification in which phosphates of the backbone of the nucleotides contained in the mRNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized artificial nucleic acids, preferably mRNAs, may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-0-(1-thiophosphate)).

In the following, specific modifications are described, which are preferably capable of "stabilizing" the inventive artificial nucleic acid, preferably an mRNA, as defined herein.

Chemical Modifications:

The terms "nucleic acid modification" as used herein may refer to chemical modifications comprising backbone modifications as well as sugar modifications or base modifications.

In this context, a modified artificial nucleic acid, preferably an mRNA, as defined herein may contain nucleotide analogues/modifications, e.g. backbone modifications, sugar modifications or base modifications. A backbone modification in connection with the present invention is a modification, in which phosphates of the backbone of the nucleotides contained in an artificial nucleic acid, preferably an mRNA, as defined herein are chemically modified. A sugar modification in connection with the present invention is a chemical modification of the sugar of the nucleotides of the artificial nucleic acid, preferably an mRNA, as defined herein. Furthermore, a base modification in connection with the present invention is a chemical modification of the base moiety of the nucleotides of the artificial nucleic acid, preferably an mRNA. In this context, nucleotide analogues or modifications are preferably selected from nucleotide analogues, which are applicable for transcription and/or translation.

Sugar Modifications:

The modified nucleosides and nucleotides, which may be incorporated into a modified artificial nucleic acid, preferably an mRNA, as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R═H, alkyl, cycloalkyl, aryl, aralkyl, heteroaryl or sugar); polyethyleneglycols (PEG), $—O(CH_2CH_2O)nCH_2CH_2OR$; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamine) or aminoalkoxy.

"Deoxy" modifications include hydrogen, amino (e.g. $NH_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, an artificial nucleic acid, preferably an mRNA, can include nucleotides containing, for instance, arabinose as the sugar.

Backbone Modifications:

The phosphate backbone may further be modified in the modified nucleosides and nucleotides, which may be incorporated into a modified artificial nucleic acid, preferably an mRNA, as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified nucleic acid, preferably an mRNA, as described herein can further be modified in the nucleobase moiety. Examples of nucleobases found in a nucleic acid such as RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-G-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiacytidine-5'-triphosphate, 2-thiouridine-5'-triphosphate, 2'-Fluorothymidine-5'-triphosphate, 2'-D-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bramouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine. In other embodiments, modified nucleosides include 2-aminopurine, 2, G-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-0-(1-thiophosphate)-adenosine, 5'-0-(1-thiophosphate)-cytidine, 5'-0-(1-thiophosphate)-guanosine, 5'-0-(1-thiophosphate)-uridine or 5'-0-(1-thiophosphate)-pseudouridine.

In further specific embodiments, a modified artificial nucleic acid, preferably an mRNA, may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Lipid Modification:

According to a further embodiment, a modified artificial nucleic acid, preferably an mRNA, as defined herein can contain a lipid modification. Such a lipid-modified artificial nucleic acid as defined herein typically further comprises at least one linker covalently linked with that artificial nucleic acid, and at least one lipid covalently linked with the respective linker. Alternatively, the lipid-modified artificial nucleic acid comprises at least one artificial nucleic acid as defined herein and at least one (bifunctional) lipid covalently linked (without a linker) with that artificial nucleic acid. According to a third alternative, the lipid-modified artificial nucleic acid comprises an artificial nucleic acid molecule as defined herein, at least one linker covalently linked with that artificial nucleic acid, and at least one lipid covalently linked with the respective linker, and also at least one (bifunctional) lipid covalently linked (without a linker) with that artificial nucleic acid. In this context, it is particularly preferred that the lipid modification is present at the terminal ends of a linear artificial nucleic acid.

Coding Sequence Modifications:

G/C Content Modification:

According to another embodiment, the artificial nucleic acid of the present invention may be modified, and thus stabilized, by modifying the G/C content of the artificial nucleic acid, preferably an mRNA, preferably of the coding region of the inventive artificial nucleic acid.

Preferably, the G/C content of the at least one coding region of the artificial nucleic acid, preferably an mRNA, is modified, preferably increased, compared to the G/C content of the corresponding coding sequence of the wild type nucleic acid, preferably an mRNA, wherein the encoded amino acid sequence is preferably not modified compared to the amino acid sequence encoded by the corresponding wild type nucleic acid (i.e. the non-modified nucleic acid), preferably an mRNA. This modification of the inventive artificial nucleic acid, preferably of an mRNA, as described herein is based on the fact that the sequence of any mRNA region to be translated is important for efficient translation of that mRNA. Thus, the composition and the sequence of various nucleotides are important. In particular, sequences having an increased G (guanosine)/C (cytosine) content are more stable than sequences having an increased A (adenosine)/U (uracil) content. According to the invention, the codons of the artificial nucleic acid, preferably an mRNA, are therefore varied compared to the respective wild type mRNA, while retaining the translated amino acid sequence, such that they include an increased amount of G/C nucleotides. In respect to the fact that several codons encode one and the same amino acid (so-called degeneration of the genetic code), the most favorable codons for the stability can be determined (so-called alternative codon usage). Depending on the amino acid to be encoded by the artificial nucleic acid, preferably an mRNA, there are various possibilities for modification of its sequence, compared to its wild type sequence. In the case of amino acids which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons, which contain a lower content of A and/or U nucleotides. Examples of these are: the codons for Phe can be modified from UUU to UUC; the codons for Leu can be modified from UUA, UUG, CUU or CUA to CUC or CUG the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to uAG or UGA. In the case of the codons for Met (AUG) and Trp (UGG), on the other hand, there is no possibility of sequence modification. The substitutions listed above can be used either individually or in all possible combinations to increase the G/C content of the inventive artificial nucleic acid, preferably an mRNA, compared to its corresponding wild type sequence, such as the corresponding wild type mRNA sequence. Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or ACG) and substitution of all codons originally coding for Ser to UCC (or UCG or ADC); substitution of all codons coding for Ile in the original sequence to AUG and substitution of all codons originally coding for Lys to AAG and substitution of all codons originally coding for Tyr to DC; substitution of all mhos coding for Val in the original sequence to DUD (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAB and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc. Preferably, the G/C content of the coding region of the inventive artificial nucleic acid, preferably an mRNA, is increased by at least 7%, more preferably by at least 15%, particularly preferably by at least 20%, compared to the G/C content of the coding region of the wild type nucleic acid. According to a specific embodiment at least 5%, 10%, 20%, 30%, 40%, 50%, 60%, more preferably at least 70%, even more preferably at least 80% and mast preferably at least 90%, 95% or even 100% of the substitutable codons in the coding region or the whale sequence of the wild type nucleic acid sequence, preferably an mRNA sequence, are substituted, thereby increasing the G/C content of said sequence. In this context, it is particularly preferable to increase the G/C content of the inventive artificial nucleic acid to the maximum (i.e. 100% of the substitutable codons), in particular in the region coding for the at least one protein, compared to the wild type sequence.

In one embodiment of the invention, the G/C content of the artificial nucleic acid of the invention is increased compared to the G/C content of the corresponding coding sequence of the wild type mRNA, or wherein the C content of the coding region of the mRNA sequence is increased compared to the C content of the corresponding coding sequence of the wild type mRNA, or wherein the codon usage in the coding region of the mRNA sequence is adapted to the human codon usage, or wherein the codon adaptation index (CAI) is increased or maximised in the coding region of the mRNA sequence, wherein the encoded amino acid sequence of the mRNA sequence is preferably not being modified compared to the encoded amino acid sequence of the wild type mRNA.

In a further embodiment, the artificial nucleic acid according to the invention is codon optimized, wherein (i) the at least one coding region comprises a nucleic acid sequence, which is codon-optimized; and/or (ii) the at least one coding sequence comprises a nucleic acid sequence, which is identical or at least 50%, 60%, 70%, 80%, 85%, 89%, 87%, 88%, 89%, 90%, 91%, 92%, 93%, 94%, 95%, 96%, 97%, 98%, or 99% identical to a nucleic acid sequence selected from the group consisting of SEQ ID NOs: 8821-13230, 26461-39690, 39715, 39716, 39717, 39720, 39721, 39724, 39725, 39728, 39729, 39730, 39733, 39734, 39737, 39738, 39741, 39742, 39745 and 39746, or a fragment or variant of any of these sequences; and/or (iii) the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 13231-17640, or a fragment or variant of any of these sequences; and/or (iv) the artificial nucleic acid of the invention, wherein the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17641-22050, or a fragment or variant of any of these sequences; and/or (v) the artificial nucleic acid of the invention, wherein the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 22051-26460, or a fragment or variant of any of these sequences.

According to the invention, a further preferred modification of the artificial nucleic acid of the present invention is based on the finding that the translation efficiency is also determined by a different frequency in the occurrence of tRNAs in cells. It is thus preferred that the at least one coding region of the artificial nucleic acid according to the invention comprises a nucleic acid sequence, which is codon-optimized. The term "codon-optimized" as used herein typically refers to an artificial nucleic acid, preferably to a nucleic acid sequence in the at least one coding region therein, wherein at least one radon of the wild type sequence, which codes for a tRNA which is relatively rare in the cell, is exchanged for a radon, which codes for a tRNA which is relatively frequent in the cell and carries the same amino acid as the relatively rare tRNA. Most preferably, that modification also increases the G/C content of the at least one coding region of the artificial nucleic acid.

Thus, if so-called "rare codons" are present in the artificial nucleic acid of the present invention to an increased extent, the corresponding modified nucleic acid sequence, preferably an mRNA sequence, is translated to a significantly poorer degree than in the case where codons coding for relatively "frequent" tRNAs are present. According to the invention, in the modified artificial nucleic acid of the present invention, the region which encodes the at least one protein as defined herein is modified compared to the corresponding region of the wild type nucleic acid, preferably an mRNA, such that at least one radon of the wild type sequence, which codes for a tRNA which is relatively rare in the cell, is exchanged for a radon, which codes for a tRNA which is relatively frequent in the cell and carries the same amino acid as the relatively rare tRNA. By this modification, the sequences of the artificial nucleic acid of the present invention is modified such that codons for which frequently occurring tRNAs are available are inserted. In other words, according to the invention, by this modification all codons of the wild type sequence which code for a tRNA which is relatively rare in the cell can in each case be exchanged for a codon which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons which use for the particular amino acid the tRNA which occurs the most frequently, e.g. the Gly radon, which uses the tRNA, which occurs the most frequently in the (human) cell, are particularly preferred. According to the invention, it is particularly preferable to link the sequential G/C content which is increased, in particular maximized, in the modified artificial nucleic acid of the present invention, with the "frequent" codons without modifying the amino acid sequence of the protein encoded by the coding region of the corresponding wild type nucleic acid, preferably an mRNA. This preferred embodiment allows provision of a particularly efficiently translated and stabilized (modified) artificial nucleic acid of the present invention. The determination of an artificial nucleic acid of the present invention as described above (increased G/C content; exchange of tRNAs) can be carried out using the computer program explained in WO 02/098443—the disclosure content of which is included in its full scope in the present invention. Using this computer program, the nucleotide sequence of any desired mRNA can be modified with the aid of the genetic code or the degenerative nature thereof such that a maximum G/C content results, in combination with the use of codons which code for tRNAs occurring as frequently as possible in the cell, the amino acid sequence encoded by the artificial nucleic acid preferably not being modified compared to the non-modified sequence. Alternatively, it is also possible to modify only the G/C content or only the radon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the artificial nucleic acid of the present invention is increased compared to the A/U content in the environment of the ribosome binding site of its particular wild type nucleic acid, preferably an mRWA. This modification (an increased A/U content around the ribosome binding site) increases the efficiency of ribosome binding to the artificial nucleic acid. An effective binding of the ribosomes to the ribosome binding site (e.g. a Kozak sequence as known in the art) in turn has the effect of an efficient translation of the artificial nucleic acid. According to a further embodiment of the present invention, the artificial nucleic acid of the present invention may be modified with respect to potentially destabilizing sequence elements. Particularly, the coding region and/or the 5' and/or 3' untranslated region of the artificial nucleic acid may be modified compared to the particular wild type nucleic acid such that it contains no destabilizing sequence elements, the amino acid sequence encoded by the modified artificial nucleic acid preferably not being modified compared to its particular wild type nucleic acid. It is known that, for example, in sequences of eukaryotic RNAs destabilizing sequence elements (USE) occur, to which signal proteins bind and regulate enzymatic degradation of RNA in vivo. For further stabilization of the modified artificial nucleic acid, optionally in the region which encodes the at least one protein as defined herein, one or more such modifications compared to the corresponding region of the wild type nucleic acid, preferably an mRWA, can therefore be carried out, so that no or substantially no destabilizing sequence elements are contained there. According to the invention, DSE present in the untranslated regions (3'- and/or 5'-UTR) can also be eliminated from the artificial nucleic acid of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83:1670 to 1674). The artificial nucleic acid of the present invention is therefore preferably modified compared to the wild type nucleic acid such that the artificial nucleic acid contains no such destabilizing sequences. This also applies to those sequence motifs which are recognized by possible endonucleases, e.g. the sequence GAACAAG, which is contained in the 3'-UTR segment of the gene which codes for the transferrin receptor (Binder et al., EMBO J. 1994, 13: 1999 to 1980). These sequence motifs are also preferably removed in the artificial nucleic acid of the present invention. It is further preferred that the artificial nucleic acid of the present invention has, in a modified form, at least one IRES as defined above and/or at least one 5' and/or 3' stabilizing sequence, in a modified form, e.g. to enhance ribosome binding or to allow expression of different encoded polypeptides located on an artificial nucleic acid of the present invention. This particularly applies to embodiments, wherein the artificial nucleic acid is bi- or multicistronic and wherein an IRES is preferably located between individual coding regions.

According to a preferred embodiment, the at least one coding region of the artificial nucleic acid or artificial nucleic acid molecule comprises or consists of at least one nucleic acid sequence according to any one of SEQ ID NOs: 8821-39690, 39715, 39719, 39717, 39720, 39721, 39724, 39725, 39728, 39729, 39730, 39733, 39734, 39737, 39738, 39741, 39742, 39745 and 39749, or a fragment or variant of any of these sequences. More preferably, the at least one coding region of the artificial nucleic comprises or consists of an RNA sequence, which is at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%. 92%, 93%, 94%, 95%, 96%, 97%, 98%, or 99% identical to any one of SEQ ID NOs: 8821-39990, 39715, 39719, 39717, 39720, 39721, 39724, 39725, 39728, 39729, 39730, 39733, 39734, 39737, 39738, 39741, 39742, 39745 and 39749.

G/C Content Modification:

According to another embodiment, the RNA of the present invention, preferably an mRNA, may be modified, and thus stabilized, by modifying the guanosine/cytosine (G/C) content of the RNA, preferably of the at least one coding sequence of the RNA of the present invention.

In a particularly preferred embodiment of the present invention, the G/C content of the coding region of the RNA of the present invention is modified, particularly increased, compared to the G/C content of the coding region of the respective wild type RNA, i.e. the unmodified RNA. The amino acid sequence encoded by the RNA is preferably not modified as compared to the amino acid sequence encoded by the respective wild type RNA. This modification of the RNA of the present invention is based on the fact that the sequence of any RNA region to be translated is important for efficient translation of that RNA. Thus, the composition of the RNA and the sequence of various nucleotides are important. In particular, sequences having an increased G (guanosine)/C (cytosine) content are more stable than sequences having an increased A (adenosine)/U (uracil) content. According to the invention, the codons of the RNA are therefore varied compared to the respective wild type RNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the RNA, there are various possibilities for modification of the RNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code far the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GGU or GCC to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to MG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild type mRNA (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type mRNA) to ACC (or AGG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the RNA of the present invention is increased by at least 7%, more preferably by at least 15%, particularly preferably by at least 20%, compared to the G/C content of the coding region of the wild type RNA, which codes for an antigen as defined herein or a fragment or variant thereof. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for an antigen as defined herein or a fragment or variant thereof or the whole sequence of the wild type RNA sequence are substituted, thereby increasing the GC/content of said sequence. In this context, it is particularly preferable to increase the G/C content of the RNA of the present invention, preferably of the at least one coding region of the RNA according to the invention, to the maximum (i.e. 100% of the substitutable codons) as compared to the wild type sequence. According to the invention, a further preferred modification of the RNA of the present invention is based on the finding that the translation efficiency is also determined by a different frequency in the occurrence of tRNAs in cells. Thus, if so-called "rare codons" are present in the RNA of the present invention to an increased extent, the corresponding modified RNA sequence is translated to a significantly poorer degree than in the case where codons coding for relatively "frequent" tRNAs are present. According to the invention, in the modified RNA of the present invention, the region which codes for an antigen as defined herein or a fragment or variant thereof is modified compared to the corresponding region of the wild type RNA such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequences of the RNA of the present invention are modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(9): 690-999. The codons, which use for the particular amino acid the tRNA which occurs the most frequently, e.g. the Gly codon, which uses the tRNA, which occurs the mast frequently in the (human) cell, are particularly preferred. According to the invention, it is particularly preferable to link the sequential G/C content which is increased, in particular maximized, in the modified RNA of the present invention, with the "frequent" codons without modifying the amino acid sequence of the protein encoded by the coding region of the RNA. This preferred embodiment allows provision of a particularly efficiently translated and stabilized (modified) RNA of the present invention. The determination of a modified RNA of the present invention as described above (increased G/C content; exchange of tRNAs) can be carried out using the computer program explained in WO 02/098443 the disclosure content of which is included in its full scope in the present invention. Using this computer program, the nucleotide sequence of any desired RNA can be modified with the aid of the genetic code or the degenerative nature thereof such that a maximum G/C content results, in combination with the use of codons which code for tRNAs occurring as frequently as possible in the cell, the amino acid sequence coded by the modified RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the RNA of the present invention is increased compared to the A/U content in the environment of the ribosome binding site of its respective wild type mRNA. This modification (an increased A/U content around the ribosome binding site) increases the efficiency of ribosome binding to the RNA. An effective binding of the ribosomes to the ribosome binding site (Kozak sequence: SEQ ID NOs: 39711, 39712; the AUG forms the start codon) in turn has the effect of an efficient translation of the RNA. According to a further embodiment of the present invention, the RNA of the present invention may be modified with respect to potentially destabilizing sequence elements. Particularly, the coding region and/or the 5' and/or 3' untranslated region of this RNA may be modified compared to the respective wild type RNA such that it contains no destabilizing sequence elements, the encoded amino acid sequence of the modified RNA preferably not being modified compared to its respective wild type RNA. It is known that, for example in sequences of eukaryotic RNAs, destabilizing sequence elements (DSE) occur, to which signal proteins bind and regulate enzymatic degradation of RNA in vivo. For further stabilization of the modified RNA, optionally in the region which encodes an antigen as defined herein or a fragment or variant thereof, one or more such modifications compared to the corresponding region of the wild type RNA can therefore be carried out, so that no or substantially no destabilizing sequence elements are contained there. According to the invention, DSE present in the untranslated regions (3'- and/or 5'-UTR) can also be eliminated from the RNA of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83:1670 to 1674). The RNA of the present invention is therefore preferably modified compared to the respective wild type RNA such that the RNA of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed in the RNA of the present invention.

According to a preferred embodiment, the present invention provides an RNA as defined herein comprising at least one coding sequence, wherein the coding sequence comprises or consists of any one of the (modified) nucleic acid sequences defined in SEQ ID NOs: 8821-13230, 39715, 39716, 39717, 39720, 39721, 39724, 39725, 39728, 39729, 39730, 39733, 39734, 39737, 39738, 39741, 39742, 39745, 39746, and/or SEQ ID NOs: 25451-30870, and/or SEQ ID NOs: 30871-35280, and/or SEQ ID NOs: 35281-39690, and/or SEQ ID NO: 39713 to SEQ ID NO:39746, and/or SEQ ID NO: 39714, 39716, 39729, 39734, 39738, 39725, or of a fragment or variant of any one of these sequences. In other words, the at least one coding sequence preferably comprises or consists of a nucleic acid sequence selected from the group consisting of SEQ ID NOs: 8821-13230, 39715, 39716, 39717, 39720, 39721, 39724, 39725, 39728, 39729, 39730, 39733, 39734, 39737, 39738, 39741, 39742, 39745, 39746, and/or SEQ ID NOs: 26461-30870, and/or SEQ ID NOs: 30871-35280, and/or SEQ ID NOs: 35281-39690, and/or SEQ ID NO: 39713 to SEQ ID NO: 39746, and/or SEQ ID NO: 39714, 39716, 39729, 39734, 39738, 39725, or a fragment or variant of any one of these nucleic acid sequences.

In a further preferred embodiment, the at least one coding sequence of the RNA according to the invention comprises or consists of a nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even mare preferably at least 85%, even more preferably of at least 90% and most preferably of at least 95% or even 97%, with any one of the (modified) nucleic acid sequences defined in SEQ ID NOs: 8821-13230, 39715, 39716, 39717, 39720, 39721, 39724, 39725, 39728, 39729, 39730, 39733, 39734, 39737, 39738, 39741, 39742, 39745, 39745, and/or SEQ ID NOs: 25451-30870, and/or SEQ ID NOs: 30871-35280, and/or SEQ ID NOs: 35281-39690, and/or SEQ ID NO: 39713 to SEQ ID NO: 39746, and/or SEQ ID NOs: 39714, 39716, 39729, 39734, 39738, 39725, or of a fragment or variant of any one of these sequences.

According to a particularly preferred embodiment, the at least one coding sequence of the RNA according to the invention comprises or consists of a nucleic acid sequence having a sequence identity of at least 80% with any one of the (modified) nucleic acid sequences defined in SEQ ID NOs: 8821-13230, 39715, 39716, 39717, 39720, 39721, 39724, 39725, 39728, 39729, 39730, 39733, 39734, 39737, 39738, 39741, 39742, 39745, 39746, and/or SEQ ID NOs: 25461-30870, and/or SEQ ID Hs: 30871-35280, and/or SEQ ID NOs: 35281-39690, and/or SEQ ID NO: 39713 to SEQ ID NO: 39745, and/or SEQ ID NOs: 39714, 39715, 39729, 39734, 39738, 39725, or of a fragment or variant of any one of these sequences.

GC Optimized Sequences:

In a preferred embodiment, the present invention provides an RNA comprising at least one coding sequence, wherein the coding sequence comprises or consists of a nucleic acid sequence selected from the group consisting of SEQ ID NOs: 39714, 39716, 39729, 39734, 39738, 39725, or a fragment or variant of any one of these nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NOs: 39714, 39715, 39729, 39734, 39738, 39725, or a fragment or variant of any one of these nucleic acid sequences.

Sequences Adapted to Human Codon Usage:

According to the invention, a further preferred modification of the RNA of the present invention is based on the finding that codons encoding the same amino acid typically occur at different frequencies. According to the invention, in the modified RNA of the present invention, the coding sequence (coding region) as defined herein is preferably modified compared to the corresponding region of the respective wild type RNA such that the frequency of the codons encoding the same amino acid corresponds to the naturally occurring frequency of that codon according to the human codon usage as e.g. shown in Table 2.

For example, in the case of the amino acid alanine (Ala) present in an amino acid sequence encoded by the at least one coding sequence of the RNA according to the invention, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 2).

TABLE 2

Human codon usage table

| Amino acid | codon | fraction | /1000 | Amino acid | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.09 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 9.1 |
| Ile | ATT | 0.35 | 19.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.09 | 7.7 | Val | GTT | 0.17 | 11.0 |
| Leu | CTG* | 0.43 | 39.9 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.9 | Tyr | TAC* | 0.58 | 15.3 |
| Met | ATG* | 1 | 22.0 | Stop | TGA* | 0.91 | 1.9 |
| Asn | AAT | 0.44 | 17.0 | Stop | TAG | 0.17 | 0.8 |
| Asn | AAC* | 0.59 | 19.1 | Stop | TAA | 0.22 | 1.0 |

*most frequent codon

In a preferred embodiment, the present invention provides an RNA comprising at least one coding sequence, wherein the coding sequence comprises a nucleic acid sequence selected from the group consisting of SEQ ID NOs: 17641-22050, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 89%, 87%, 88%, 89%, 90%, 91%, 92%, 93%, 94%, 95%, 99%, 97%, 98%, or 99%, preferably of at least 70%, more preferably of at least 80%, even more preferably at least 85%, even more preferably of at least 90% and mast preferably of at least 95% or even 97%, with a nucleic acid sequence selected from the group consisting of SEQ ID NOs: 17641-22050, or a fragment or variant of any one of said nucleic acid sequences.

Codon-Optimized Sequences:

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 2, most frequent codons are marked with asterisks). Such an optimization procedure increases the codon adaptation index (CAI) and ultimately maximises the CAI. In the context of the invention, sequences with increased or maximized CAI are typically referred to as “codon-optimized” sequences and/or CAI increased and/or maximized sequences. According to a preferred embodiment, the RNA of the present invention comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon “GCC” is always used for said amino acid, or for the amino acid Cysteine (Cys), the wild type sequence is adapted in a way that the most frequent human codon “TGC” is always used for said amino acid etc.

In a preferred embodiment, the present invention provides an RNA comprising at least one coding sequence, wherein the coding sequence comprises a nucleic acid sequence selected from the group consisting of SEQ ID NOs: 22051-29490, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 89%, 87%, 88%, 89%, 90%, 91%, 92%, 93%, 94%, 95%, 98%, 97%, 98%, or 99%, preferably of at least 70%, mare preferably of at least 80%, even more preferably at least 85%, even more preferably of at least 90% and most preferably of at least 95% or even 97%, with a nucleic acid sequence selected from the group consisting of SEQ ID NOs: 22051-29460, or a fragment or variant of any one of said nucleic acid sequences.

C-Optimized Sequences:

According to another embodiment, the RNA of the composition of the present invention may be modified by modifying, preferably increasing, the cytosine (C) content of the RNA, preferably of the coding region of the RNA.

In a particularly preferred embodiment of the present invention, the C content of the coding region of the RNA of the present invention is modified, preferably increased, compared to the C content of the coding region of the respective wild type RNA, i.e. the unmodified RNA. The amino acid sequence encoded by the at least one coding sequence of the RNA of the present invention is preferably not modified as compared to the amino acid sequence encoded by the respective wild type mRNA.

In a preferred embodiment of the present invention, the modified RNA is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target RNA wild type sequence, which are “cytosine content optimizable” are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gin), which is encoded by two codons each containing the same number of cytosines.

In a further preferred embodiment of the present invention, the modified target RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term “cytosine content-optimizable codon” as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C content and reflects a C-enriched modified mRNA sequence. According to a preferred embodiment, the RNA of the present invention, preferably the at least one coding sequence of the RNA of the present invention comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid. Any of the codons GCG, GCA, GCU codes for the amino acid Ala, which may be exchanged by the codon GCC encoding the same amino acid, and/or the codon HU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCG encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the RNA according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized RNA of the invention, at least 50% of the C-optimizable wild type codons for any given amino acid are replaced by C-optimized codons, e.g. any modified C-enriched RNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 00%.

In this context codons encoding amino acids, which are not cytosine content-optimizable and which are, however, encoded by at least two codons, may be used without any further selection process. However, the radon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized; however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified RNA compared to the wild type mRNA sequence.

Accordingly, the at least one coding sequence as defined herein may be changed compared to the coding region of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In a preferred embodiment, the present invention provides an RNA comprising at least one coding sequence, wherein the coding sequence comprises a nucleic acid sequence selected from the group consisting of SEQ ID Hs: 13231-17640, or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 89%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NOs: 13231-17940, or a fragment or variant of any one of said nucleic acid sequences.

According to a particularly preferred embodiment, the invention provides an RNA, preferably an mRNA, comprising at least one coding sequence as defined herein, wherein the G/C content of the at least one coding sequence of the RNA is increased compared to the G/C content of the corresponding coding sequence of the corresponding wild type RNA, and/or wherein the C content of the at least one coding sequence of the RNA is increased compared to the C content of the corresponding coding sequence of the corresponding wild type RNA, and/or wherein the codons in the at least one coding sequence of the RNA are adapted to human codon usage, wherein the codon adaptation index (CAI) is preferably increased or maximised in the at least one coding sequence of the RNA, and wherein the amino acid sequence encoded by the RNA is preferably not being modified compared to the amino acid sequence encoded by the corresponding wild type RNA.

5'-Cap Structure:

Modification of the 5'-End of a Modified Artificial Nucleic Acid:

According to another preferred embodiment of the invention, the artificial nucleic acid, preferably an mRNA, as defined herein, can be modified by the addition of a so-called "5'-cap" structure, which preferably stabilizes the nucleic acid, preferably an mRNA, as described herein.

In a particularly preferred embodiment, the artificial nucleic acid according to the invention, preferably an mRNA, comprises a 5'-cap structure.

A 5'-cap is an entity, typically a modified nucleotide entity, which generally "caps" the 5'-end of a nucleic acid, for example of a mature mRNA. A 5'-cap may typically be formed by a modified nucleotide, particularly by a derivative of a guanine nucleotide. Preferably, the 5'-cap is linked to the 5'-terminus via a $5^1$-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in an artificial nucleic acid in this context. Accordingly, a modified artificial nucleic acid, preferably an mRNA, of the present invention may comprise an m7GpppN as 5'-cap, but additionally the modified artificial nucleic acid, preferably an mRNA, typically comprises at least one further modification as defined herein.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m70), cap2 (additional methylation of the ribose of the 2nd nucleotide downstream of the m70), cap3 (additional methylation of the ribose of the 3rd nucleotide downstream of the m7G), cap4 (additional methylation of the ribose of the 4th nucleotide downstream of the m70), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

5'-UTRs:

According to a further embodiment, the artificial nucleic acid comprises an untranslated region (UTR). More preferably, the artificial nucleic acid according to the invention, preferably an mRNA, comprises at least one of the following structural elements: a 5'- and/or 3'-untranslated region element (UTR element), particularly a 5'-UTR element, which comprises or consists of a nucleic acid sequence which is derived from the 5'-UTR of a TOP gene or from a fragment, homolog or a variant thereof, or a 5'- and/or 3'-UTR element which may be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

In a preferred embodiment, the artificial nucleic acid, preferably an mRNA, comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably the 5'- or 3'-UTR element used according to the present invention is heterologous to the coding region of the inventive artificial nucleic acid. Even if 5'- or 3'-UTR elements derived from naturally occurring genes are preferred, also synthetically engineered UTR elements may be used in the context of the present invention.

According to a preferred embodiment, the artificial nucleic acid according to the invention comprises a 5'-UTR. More preferably, the artificial nucleic acid comprises a 5'-UTR comprising at least one heterologous 5'-UTR element.

In a particularly preferred embodiment, the artificial nucleic acid comprises at least one 5'-untranslated region element (5'-UTR element), preferably a heterologous 5'-UTR element, which comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'TOP, as defined above.

In same embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the artificial nucleic acid is provided by the at least one coding region.

The nucleic acid sequence, which is derived from the 5'-UTR of a TOP gene, is typically derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO:1395, SEQ ID NO: 1421 and SEQ ID NO: 1422 of the patent application WO 2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO 2013/143700, from a variant thereof, or preferably from a corresponding RNA sequence. The term "homologs of SEQ ID Hs: 1-1393, SEQ ID NO: 1395, SEQ ID NO: 1421 and SEQ ID NO: 1422 of the patent application WO 2013/143700" refers to sequences of other species than *Homo sapiens*, which are homologous to the sequences according to SEQ ID NOs: 1-1393, SEQ ID NO:1395, SEQ ID NO: 1421 and SEQ ID NO: 1422 of the patent application WO 2013/143700.

In a preferred embodiment, the 5'-UTR element of the artificial nucleic acid, preferably an mRNA, comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs: 1-1393, SEQ ID NO:1395, SEQ ID NO:1421 and SEQ ID NO: 1422 of the patent application WO 2013/143700, from the homologs of SEQ ID NOs: 1-1393, SEQ ID NO:1395, SEQ ID NO:1421 and SEQ ID NO: 1422 of the patent application WO 2013/143700 from a variant thereof, or a corresponding RNA sequence. It is particularly preferred that the 5'-UTR element is derived from a nucleic acid sequence extending from the nucleotide position immediately 3' to the 5'TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1393, SEQ ID NO:1395, SEQ ID NO: 1421 and SEQ ID NO: 1422 of the patent application WO 2013/143700, from the homologs of SEQ ID NOs: 1-1393, SEQ ID NO: 1395, SEQ ID NO: 1421 and SEQ ID NO: 1422 of the patent application WO 2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NO: 97, 170, 193, 244, 259, 554, 950, 975, 700, 721, 913, 1016, 1093, 1120, 1138, and 1284-1390 of the patent application WO 2013/143700, a corresponding RNA sequence, a homing thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

In one embodiment, the sequences of the invention are selected from the group of any of SEQ ID NOs: 1-4410, or a fragment or variant of any of these sequences, wherein these sequences resemble VP1 protein sequences.

In one embodiment, the sequences of the invention are selected from the group of any of SEQ ID NOs: 4411-8820, 39713, 39714, 39718, 39719, 39722, 39723, 39726, 39727, 39731, 39732, 39735, 39736, 39739, 39740, 39743 and 39744, or a fragment or variant of any of these sequences, wherein these sequences resemble VP1 nucleotide wild type sequences.

In one embodiment, the sequences of the invention are selected from the group of any of SEQ ID NOs: 8821-13230, 39715, 39719, 39717, 39720, 39721, 39724, 39725, 39728, 39729, 39730, 39733, 39734, 39737, 39738, 39741, 39742, 39745, 39746, and/or SEQ ID NOs: 26461-30870, and/or SEQ ID NOs: 30871-35280, and/or SEQ ID NOs: 35781-39690, and/or SEQ ID NO:39713 to SEQ ID NO:39746, and/or SEQ ID NO: 39714, 39716, 39729, 39734.39738, 39725, or a fragment or variant of any of these sequences, wherein these sequences resemble optimized VP1 nucleotide wild type sequences.

In one embodiment, the sequences of the invention are selected from the group of any of SEQ ID NOs: 13231-17640, or a fragment or variant of any of these sequences, wherein these sequences resemble optimized VP1 nucleotide wild type sequences.

In one embodiment, the sequences of the invention are selected from the group of any of SEQ ID NOs: 17641-22050, or a fragment or variant of any of these sequences, wherein these sequences resemble optimized VP1 nucleotide wild type sequences.

In one embodiment, the sequences of the invention are selected from the group of any of SEQ ID NOs: 22051-26460, or a fragment or variant of any of these sequences, wherein these sequences resemble optimized VP1 nucleotide wild type sequences.

In one embodiment, the sequences of the invention are selected from the group of any of SEQ ID NOs: 26461-30870, or a fragment or variant of any of these sequences, wherein these sequences resemble optimized VP1 nucleotide wild type sequences.

In one embodiment, the sequences of the invention are selected from the group of any of SEQ ID NOs: 30871-35280, or a fragment or variant of any of these sequences, wherein these sequences resemble optimized VP1 nucleotide wild type sequences.

In one embodiment, the sequences of the invention are selected from the group of any of SEQ ID NOs: 35281-39690, or a fragment or variant of any of these sequences, wherein these sequences resemble optimized VP1 nucleotide wild type sequences.

Preferably, the artificial nucleic acid according to the invention comprises a 5'-UTR comprising at least one heterologous 5'-UTR sequence, wherein the at least one heterologous 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the 5'TOP motif.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO 2013/143700, a corresponding RNA sequence, a homolog thereof, or a variant thereof as described herein, preferably lacking the 5'TOP motif.

In a particularly preferred embodiment, the 5'-UTR element comprises or consists of a nucleic acid sequence, which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'TOP of said gene.

Accordingly, in a particularly preferred embodiment, the 5'-UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 20649 (5'-UTR of human ribosomal protein Large 32 lacking the 5'-terminal oligopyrimidine tract; corresponding to SEQ ID NO: 1368 of the patent application WO 2013/143700) or preferably to a corresponding RNA sequence, such as SEQ ID NO: 39692, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 39691, or more preferably to a corresponding RNA sequence, such as SEQ ID NO: 39692, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the artificial nucleic acid according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS5, RPS15A, RPS16, RPS17, RPS18, RPS19, RPS20, RPS21, RPS23, RPS24, RPS25, RPS26, RP327, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the STOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

According to a preferred embodiment, the artificial nucleic acid comprises at least one heterologous 5'-UTR element comprising a nucleic acid sequence, which is derived from a 5'-UTR of a TOP gene encoding a ribosomal Large protein (RPL), preferably RPL32 or RPL35A, or from a gene selected from the group consisting of HSD17134, ATP5A1, AIG1, ASAH1, COX6C or ABCB7 (also referred to herein as MDR), or from a homolog, a fragment or variant of any one of these genes, preferably lacking the 5'TOP motif.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit Vlc gene (COX6C), a N-acylsphingosine amidohydrolase (acid ceramidase) 1 gene (ASAH1), or an ATP-Binding Cassette, Sub-Family B (MDR/TAP), Member 7 gene (ABCB7), or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD1784), a vertebrate androgen-induced 1 gene (AIG1), a vertebrate cytochrome c oxidase subunit VIc gene (COX6C), a vertebrate N-acylsphingosine amidohydrolase (acid ceramidase) 1 gene (ASAH1), or a vertebrate ATP-Binding Cassette, Sub-Family B (MDR/TAP), Member 7 gene (ABCB7), or from a variant thereof, mare preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), a mammalian N-acylsphingosine ami-do-hydrolase (acid ceramidase) 1 gene (ASAH1), or a mammalian ATP-Binding Cassette, Sub-Family B (MDR/TAP), Member 7 gene (ABCB7), or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HS017B4), a human androgen-induced 1 gene (AIG1), a human cytochrome c oxidase subunit VIc gene (COX6C), a human N-acylsphingosine amidohydrolase (acid ceramidase) 1 gene (ASAH1), or a human ATP-Binding Cassette, Sub-Family B (MDR/TAP), Member 7 gene (ABCB7), or from a variant thereof, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO 2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO 2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

According to a particularly preferred embodiment, the artificial nucleic acid comprises a 5'-UTR comprising at least one heterologous 5'-UTR element, wherein the heterologous 5'-UTR element comprises a nucleic acid sequence according to SEQ ID NO: 39691 to SEQ ID NO: 39694, or a homolog, a fragment or a variant thereof. Preferably, the at least one heterologous 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence according to any one of SEQ ID NO: 39691 to SEQ ID NO: 39694.

According to a preferred embodiment, the artificial nucleic acid according to the invention comprises a 3'-untranslated region (3'-UTR). More preferably, the artificial nucleic acid according to the invention comprises a 3'-UTR comprising or consisting of at least one heterologous 3'-UTR element, preferably as defined herein.

Poly(A) Sequence and Poly(C) Sequence:

According to a further preferred embodiment, the artificial nucleic acid, preferably the 3'-UTR, may contain a poly-A tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the artificial nucleic acid, preferably an mRNA, is derived from a DNA template by in vitro transcription. Alternatively, the poly(A) sequence may also be obtained in vitro by common methods of chemical-synthesis without being necessarily transcribed from a DNA progenitor. Moreover, poly(A) sequences, or poly(A) tails may be generated by enzymatic polyadenylation of the RNA according to the present invention using commercially available polyadenylation kits and corresponding protocols known in the art, or using immobilized poly(A)polymerases e.g. in a polyadenylation reactor (WO 2016/174271).

Alternatively, the artificial nucleic acid, preferably an mRNA, optionally comprises a polyadenylation signal, which is defined herein as a signal, which conveys polyadenylation to a (transcribed) mRNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

According to a further preferred embodiment, the artificial nucleic acid of the present invention, preferably the 3'-UTR of the artificial nucleic acid, may contain a poly-C tail of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

3'-UTRs:

In a further preferred embodiment, the artificial nucleic acid according to the invention further comprises at least one 3'-UTR element, which comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

The term "3'-UTR element" refers to a nucleic acid sequence, which comprises or consists of a nucleic acid sequence that is derived from a 3'-UTR or from a variant of a T-UTR. A 3'-UTR element in the sense of the present invention may represent the 3'-UTR on a DNA or on an RNA level. Thus, in the sense of the present invention, preferably, a 3'-UTR element may be the 3'-UTR of an mRNA, preferably of an artificial mRNA, or it may be the transcription template for a 3'-UTR of an mRNA. Thus, a 3'-UTR element preferably is a nucleic acid sequence, which corresponds to the 3'-UTR of an mRNA, preferably to the 3'-UTR of an artificial mRNA, such as an mRNA obtained by transcription of a genetically engineered vector construct. Preferably, the 3'-UTR element fulfils the function of a 3'-UTR or encodes a sequence, which fulfils the function of a 3'-UTR.

Preferably, the artificial nucleic acid comprises a 3'-UTR element comprising or consisting of a nucleic acid sequence derived from a 3'-UTR of a gene, which preferably encodes a stable mRNA, or from a homolog, a fragment or a variant of said gene. In particular, the 3'-UTR element may be derivable from a gene that relates to an mRNA with an enhanced half-life (that provides a stable mRNA), for example a 3'-UTR element as defined and described below.

In a particularly preferred embodiment, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene. More preferably, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NOs: 1369-1390 of the patent application WO 2013/143700, whose disclosure is incorporated herein by reference, or from a homolog, a fragment or a variant thereof.

In a particularly preferred embodiment, the 3'-UTR element comprises or consists of a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to Genbank Accession number NM_000477.5, or from a fragment or variant thereof. More preferably, the 3'-UTR element comprises or consists of a nucleic acid according to SEQ ID NO: 39703, or SEQ ID NO: 39704 (corresponding to SEQ ID NO:1399 of the patent application WO 2013/143700), or a fragment, homolog or variant thereof.

Most preferably the 3'-UTR element comprises or consists of the nucleic acid sequence derived from a fragment of the human albumin gene according to SEQ ID NO: 39705, or SEQ ID NO: 39709 (corresponding to SEQ ID NO: 1376 of the patent application WO 2013/143700), or a fragment, homolog or variant thereof. Further preferably, the 3'-UTR element comprises or consists of a nucleic acid according to SEQ ID NO: 39707, or SEQ ID NO: 39708, (Albumin 7), or a fragment, homolog or variant thereof.

In another particularly preferred embodiment, the at least one heterologous 3'-UTR element comprises or consists of a nucleic acid sequence derived from a 3'-UTR of an α-globin gene, preferably a vertebrate α- or β-globin gene, more preferably a mammalian α- or β-globin gene, most preferably a human α- or β-globin gene.

More preferably, the 3'-UTR element comprises or consists of a nucleic acid according to SEQ ID NO: 39695, or SEQ ID NO: 39696 (corresponding to SEQ ID NO: 1370 of the patent application WO 2013/143700), or a homolog, a fragment, or a variant thereof Preferably, the at least one heterologous 3'-UTR element comprises or consists of a nucleic acid sequence derived from a 3'-UTR of *Homo sapiens* hemoglobin, alpha 1 (HBA1). More preferably, the 3'-UTR element comprises or consists of a nucleic acid according to SEQ ID NO: 39695, or SEQ ID NO: 39696 (corresponding to SEQ ID NO: 1370 of the patent application WD 2013/143700), or a homolog, a fragment, or a variant thereof.

In another embodiment, the at least one heterologous 3'-UTR element comprises or consists of a nucleic acid sequence derived from a 3'-UTR of *Homo sapiens* hemoglobin, alpha 2 (HBA2). More preferably, the 3'-UTR element comprises or consists of a nucleic acid according to SEQ ID NO: 39697 or SEQ ID NO: 39698 (corresponding to SEQ ID NO: 1371 of the patent application WD 2013/143700), or a homolog, a fragment, or a variant thereof.

According to another embodiment, the at least one heterologous 3'-UTR element comprises or consists of a nucleic acid sequence derived from a 3'-UTR of *Homo sapiens* hemoglobin, beta (HBB). More preferably, the 3'-UTR element comprises or consists of a nucleic acid according to SEQ ID NO: 39699, or SEQ ID NO: 39700 (corresponding to SEQ ID NO:1372 of the patent application WO 2013/143700), or a homolog, a fragment, or a variant thereof.

The at least one heterologous 3'-UTR element may further comprise or consist of the center, α-complex-binding portion of the 3'-UTR of an α-globin gene, such as of a human α-globin gene, or a homolog, a fragment, or a variant of an α-globin gene, preferably according to SEQ ID NO: 39701 or SEQ ID NO: 39702 (also referred to herein as "muag") (corresponding to SEQ ID NO: 1393 of the patent application WO 2013/143700), or a humping, a fragment, or a variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a (β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a (β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even mare preferably at least 70%, even more preferably at least 80%, and most preferably at least 90% of the full-length variant 3'-UTR. Such a fragment of a variant, in the sense of the present invention, is preferably a functional fragment of a variant as described herein.

Preferably, the at least one 5'-UTR element and the at least one 3'-UTR element act synergistically to increase protein production from the inventive artificial nucleic acid as described above.

Histone-Stem-Loop:

In a particularly preferred embodiment, the inventive artificial nucleic acid as described herein comprises a histone stem-loop sequence/structure (histone stem-loop). Such histone stem-loop sequences are preferably selected from histone stem-loop sequences as disclosed in WO 2012/019780, whose disclosure is incorporated herewith by reference.

A histone stem-loop sequence, suitable to be used within the present invention, is preferably selected from at least one of the following formulae (I) or (II):

formula (I) (stem-loop sequence without stem bordering elements):

$$\underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}$$

formula (II) (stem-loop sequence with stem bordering elements):

$$\underbrace{N_{1-6}}_{\substack{\text{stem1}\\ \text{bordering element}}}\ \underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}\ \underbrace{N_{1-6}}_{\substack{\text{stem2}\\ \text{bordering element}}}$$

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment of the first inventive aspect, the inventive artificial nucleic acid may comprise at least one histone stem-loop sequence according to at least one of the following specific formulae (Ia) or (IIa):

formula (Ia) (stem-loop sequence without stem bordering elements):

$$\underbrace{[N_{0-1}GN_{3-5}]}_{\text{stem1}}\ \underbrace{[N_{1-3}(U/T)N_{0-2}]}_{\text{loop}}\ \underbrace{[N_{3-5}CN_{0-1}]}_{\text{stem2}}$$

formula (IIa) (stem-loop sequence with stem bordering elements):

$$\underbrace{N_{2-5}}_{\substack{\text{stem1}\\ \text{bordering element}}}\ \underbrace{[N_{0-1}GN_{3-5}]}_{\text{stem1}}\ \underbrace{[N_{1-3}(U/T)N_{0-2}]}_{\text{loop}}\ \underbrace{[N_{3-5}CN_{0-1}]}_{\text{stem2}}\ \underbrace{N_{2-5}}_{\substack{\text{stem2}\\ \text{bordering element}}}$$

wherein: N, C, G, T and U are as defined above.

According to a further more particularly preferred embodiment of the first aspect, the inventive artificial nucleic acid may comprise at least one histone stem-loop sequence according to at least one of the following specific formulae (Ib) or (IIb):

formula (Ib) (stem-loop sequence without stem bordering elements):

$$\underbrace{[N_1GN_4]}_{\text{stem1}}\ \underbrace{[N_2(U/T)N_1]}_{\text{loop}}\ \underbrace{[N_4CN_1]}_{\text{stem2}}$$

formula (IIb) (stem-loop sequence with stem bordering elements):

$$\underbrace{N_{4-5}}_{\substack{\text{stem1}\\ \text{bordering element}}}\ \underbrace{[N_1GN_4]}_{\text{term1}}\ \underbrace{[N_2(U/T)N_1]}_{\text{loop}}\ \underbrace{[N_4CN_1]}_{\text{stem2}}\ \underbrace{N_{4-5}}_{\substack{\text{stem2}\\ \text{bordering element}}}$$

wherein: N, C, G, T and U are as defined above.

A particular preferred histone stem-loop sequence is the nucleic acid sequence according to SEQ ID NO: 39709, or more preferably the corresponding RNA sequence according to SEQ ID NO: 39710.

Additional Peptide or Protein Elements:

According to other preferred embodiments, the artificial nucleic acid sequence, particularly the RNA sequence according to the invention may additionally encode further peptide or protein elements that e.g., promote secretion of the protein (secretory signal peptides), promote anchoring of the encoded antigen in the plasma membrane (transmembrane domains), promote virus-like particle formation (VLP forming domains). In addition, the artificial nucleic acid sequence according to the present invention may additionally encode peptide linker elements, self-cleaving peptides or helper peptides.

According to another particularly preferred embodiment, the inventive artificial nucleic acid may additionally or alternatively encode a secretory signal peptide (signal sequence). Such signal peptides are sequences, which typically exhibit a length of about 10 to 30 amino acids and are preferably located at the N-terminus of the encoded peptide, without being limited thereto. Signal peptides as defined herein preferably allow the transport of the at least one protein encoded by the at least one coding region of the inventive artificial nucleic acid into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines as defined herein, signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartiment. More preferably, signal sequences of MHC class 1 molecule HLA-A*0201 may be used according to the present invention.

According to other embodiments, the artificial nucleic acid sequence, particularly the RNA sequence according to the invention may additionally encode at least one transmembrane domain element.

Transmembrane elements or membrane spanning polypeptide elements are present in proteins that are integrated or anchored in plasma membranes of cells. Typical transmembrane elements are alpha-helical transmembrane elements. Such transmembrane elements are composed essentially of amino acids with hydrophobic side chains, because the interior of a cell membrane (lipid bilayer) is also hydrophobic. From the structural perspective, transmembrane elements are commonly single hydrophobic alpha helices or beta barrel structures; whereas hydrophobic alpha helices are usually present in proteins that are present in membrane anchored proteins (e.g., seven transmembrane domain receptors), beta-barrel structures are often present in proteins that generate pores or channels.

For target proteins, such as antigenic peptides or proteins according to the present invention (derived from Norovirus) it may be beneficial to introduce a transmembrane element into the respective constructs. By addition of a transmembrane element to the target peptide/protein it may be possible to further enhance the immune response, wherein the translated target peptide/protein, e.g. a viral antigen, anchors to a target membrane, e.g. the plasma membrane of a cell, thereby increasing immune responses. This effect is also referred to as antigen clustering.

When used in combination with a polypeptide or protein of interest in the context of the present invention, such transmembrane element can be placed N-terminal or C-terminal to the Norovirus antigenic peptide or protein of interest. On nucleic acid level, the coding sequence for such transmembrane element is typically placed in frame (i.e. in the same reading frame), 5' or 3' to the coding sequence of the polypeptide as defined herein.

The transmembrane domain may be selected from the transmembrane domain of Hemagglutinin (HA) of Influenza virus, Env of HIV-1, EIAV (equine infectious anaemia virus), MLV (murine leukaemia virus), mouse mammary tumor virus, G protein of VSV (vesicular stomatitis virus), Rabies virus, or a transmembrane element of a seven transmembrane domain receptor.

According to other embodiments, the artificial nucleic acid sequence, particularly the RNA sequence according to the invention may additionally encode at least one VLP forming domain.

VLPs are self-assembled viral structural proteins (envelope proteins or capsid proteins) that structurally resemble viruses (without containing viral genetic material). VLPs contain repetitive high density displays of antigens which present conformational epitopes that can elicit strong T cell and B cell immune responses.

When used in combination with a Norovirus antigenic peptide or protein in the context of the present invention, such VLP forming element can be placed N-terminal or C-terminal to the polypeptide of interest. On nucleic acid level, the coding sequence for such VLP forming element is typically placed in frame (i.e. in the same reading frame), 5' or 3' to the coding sequence of the polypeptide as defined herein.

For nucleic acid (e.g. RNA) encoding a polypeptide or protein of interest, particularly Norovirus antigenic polypeptides or proteins, it may be beneficial to introduce a VLP forming element into the respective constructs. In addition to the "clustering" of epitopes, an improved secretion of the VLP particle may also increase the immunogenicity of the respective antigen.

VLP forming elements fused to an antigen may generate virus like particles containing repetitive high density displays of antigens. Essentially, such VLP forming elements can be chosen from any viral or phage capsid or envelope protein.

According to another embodiment, the artificial nucleic acid sequence, particularly the RNA sequence according to the invention may additionally encode at least one peptide linker element.

In protein constructs composed of several elements (e.g., Norovirus antigenic peptide or protein fused to a transmembrane domain), the protein elements may be separated by peptide linker elements. Such elements may be beneficial because they allow for a proper folding of the individual elements and thereby the proper functionality of each element. Alternatively, the term "spacer" or "peptide spacer" is used herein.

When used in the context of the present invention, such linkers or spacers are particularly useful when encoded by a nucleic acid encoding at least two functional protein elements, such as at least one polypeptide or protein of interest (Norovirus antigens) and at least one further protein or polypeptide element (e.g., VLP forming domain, transmembrane domain). In that case, the linker is typically located on the polypeptide chain in between the polypeptide of interest and the at least one further protein element. On nucleic acid level, the coding sequence for such linker is typically placed in the reading frame, 5' or 3' to the coding sequence for the polypeptide or protein of interest, or placed between coding regions for individual polypeptide domains of a given protein of interest.

Peptide linkers are preferably composed of small, non-polar (e.g. Gly) or polar (e.g. Ser or Thr) amino acids. The small size of these amino acids provides flexibility, and allows for mobility of the connecting functional domains. The incorporation of Ser or Thr can maintain the stability of the linker in aqueous solutions by forming hydrogen bonds with the water molecules, and therefore reduces an interaction between the linker and the protein moieties. Rigid linkers generally maintain the distance between the protein domains and they may be based on helical structures and/or they have a sequence that is rich in praline. Cleavable linkers (also termed "cleavage linkers") allow for in vivo separation of the protein domains. The mechanism of cleavage may be based e.g. on reduction of disulfide bonds within the linker sequence or proteolytic cleavage. The cleavage may be mediated by an enzyme (enzymatic cleavage), e.g. the cleavage linker may provide a protease sensitive sequence (e.g., furin cleavage).

A typical sequence of a flexible linker is composed of repeats of the amino acids Glycine (G) and Serine (S). For instance, the linker may have the following sequence: GS, GSG, SGG, SG, GGS, SGS, GSS, SSG. In some embodiments, the same sequence is repeated multiple times (e.g. two, three, four, five or six times) to create a longer linker. In other embodiments, a single amino acid residue such as S or G can be used as a linker.

Linkers or spacers may be used as additional elements to promote or improve the secretion of the target protein (Norovirus antigenic peptides or proteins).

According to other embodiments, the artificial nucleic acid sequence, particularly the RNA sequence according to the invention may additionally encode at least one self-cleaving peptide.

Viral self-cleaving peptides (2A peptides) allow the expression of multiple proteins from a single open reading frame. The terms 2A peptide and 2A element are used interchangeably herein. The mechanism by the 2A sequence for generating two proteins from one transcript is by ribosome skipping—a normal peptide bond is impaired at 2A, resulting in two discontinuous protein fragments from one translation event.

When used in the context of the present invention, such 2A peptides are particularly useful when encoded by a nucleic acid encoding at least two functional protein elements (e.g. two Norovirus antigenic peptides or proteins). In general, a 2A element is useful when the nucleic acid molecule encodes at least one polypeptide or protein of interest and at least one further protein element. In a preferred embodiment, a 2A element is present when the polynucleotide of the invention encodes two proteins or polypeptides of interest, e.g. two antigens.

The coding sequence for such 2A peptide is typically located in between the coding sequence of the polypeptide of interest and the coding sequence of the least one further protein element (which may also be a polypeptide of interest), so that cleavage of the 2A peptide leads to two separate polypeptide molecules, at least one of them being a polypeptide or protein of interest.

For example, for expressing target proteins (Norovirus antigenic peptides or proteins) that are composed of several polypeptide chains it may be beneficial to provide coding information for both polypeptide chains on a single nucleic acid molecule, separated by a nucleic acid sequence encoding a 2A peptide. 2A peptides may also be beneficial when cleavage of the protein of interest from another encoded polypeptide element is desired.

2A peptides may be derived from foot-and-mouth diseases virus, from equine rhinitis A virus, Thosea asigna virus, Porcine teschovirus-1.

According to other embodiments, the artificial nucleic acid sequence, particularly the RNA sequence according to the invention may additionally encode at least one helper peptide.

In essence, helper peptides binds to class II MHC molecules as a nonspecific vaccine helper epitope (adjuvant) and induces an increased (and long term) immune response by increasing the helper T-cell response. In an embodiment, such a helper peptide may be N-terminally and/or C-terminally fused to the antigenic peptide or protein derived from Norovirus.

mRNA Structures:

Any of the above modifications may be applied to the artificial nucleic acid of the present invention, and further to any nucleic acid as used in the context of the present invention and may be, if suitable or necessary, be combined with each other in any combination, provided, these combinations of modifications do not interfere with each other in the artificial nucleic acid. A person skilled in the art will be able to take his choice accordingly.

The artificial nucleic acid as defined herein, may preferably comprise a 5'-UTR, a coding region encoding the at least one polypeptide comprising at least one Norovirus protein as described herein, or a fragment, variant or derivative thereof; and/or a 3'-UTR preferably containing at least one histone stem-loop. The 3'-UTR of the artificial nucleic acid preferably comprises also a poly(A) and/or a poly(C) sequence as defined herewithin. The single elements of the 3'-UTR may occur therein in any order from 5' to 3' along the sequence of the artificial nucleic acid. In addition, further elements as described herein, may also be contained, such as a stabilizing sequence as defined herewithin (e.g. derived from the UTR of a globin gene), IRES sequences, etc. Each of the elements may also be repeated in the artificial nucleic acid according to the invention at least once (particularly in di- or multicistronic constructs), preferably twice or more. As an example, the single elements may be present in the artificial nucleic acid in the following order:

5'-coding region-histone stem-loop-poly(A)/(C) sequence-3'; or

5'-coding region-poly(A)/(C) sequence-histone stem-loop-3'; or

5'-coding region-histone stem-loop-polyadenylation signal-3'; or

5'-coding region-polyadenylation signal-histone stem-loop-3'; or

5'-coding region-histone stem-loop-histone stem-loop-poly(A)/(C) sequence-3'; or 5'-coding region-histone stem-loop-histone stem-loop-polyadenylation signal-3'; or 5'-coding region-stabilizing sequence-poly(A)/(C) sequence-histone stem-loop-3'; or 5'-coding region-stabilizing sequence-poly(A)/(C) sequence-poly(A)/(C) sequence-histone stem-loop-3'; etc.

In this context, it is particularly preferred that if, in addition to the at least one encoded polypeptide defined herein, a further peptide or protein is encoded by the artificial nucleic acid the encoded peptide or protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)). In a preferred embodiment, the artificial nucleic acid according to the invention does not comprise a reporter gene or a marker gene. Preferably, the artificial nucleic acid according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the artificial nucleic acid according to the invention does not encode luciferase. In another embodiment, the artificial nucleic acid according to the invention does not encode GFP or a variant thereof.

According to a preferred embodiment, the inventive artificial nucleic acid comprises or consists of, preferably in 5' to 3' direction, the following elements:

a) optionally, a 5'-cap structure (cap0, cap1, cap2), preferably m7GpppN,
b) a coding region encoding at least one protein comprising at least one Norovirus protein as described herein, or a fragment or variant thereof,
c) optionally a poly(A) tail, preferably consisting of 10 to 200, 10 to 100, 40 to 80 or 50 to 70 adenosine nucleotides,
d) optionally a poly(C) tail, preferably consisting of 10 to 200, 10 to 100, 20 to 70, 20 to 60 or 10 to 40 cytosine nucleotides, and
e) optionally a histone stem-loop, preferably comprising the RNA sequence according to SEQ ID NO: 39709 to SEQ ID NO: 39710.

More preferably, the artificial nucleic acid according to the invention comprises or consists of, preferably in 5' to 3' direction, the following elements:

a) optionally, a 5'-cap structure (cap0, cap1, cap2), preferably m7GpppN,
b) a coding region encoding at least one protein comprising at least one Norovirus protein as described herein, or a fragment or variant thereof,
c) a 3'-UTR element comprising a nucleic acid sequence, which is derived from an α-globin gene, preferably comprising the corresponding RNA sequence of the nucleic acid sequence according to SEQ ID NO: 39701, or SEQ ID NO: 39702, or a homolog, a fragment or a variant thereof,
d) optionally a poly(A) tail, preferably consisting of 10 to 200, 10 to 100, 40 to 80 or 50 to 70 adenosine nucleotides,
e) optionally a poly(C) tail, preferably consisting of 10 to 200, 10 to 100, 20 to 70, 20 to 60 or 10 to 40 cytosine nucleotides, and
f) optionally a histone stem-loop, preferably comprising the RNA sequence according to SEQ ID NO: 39709 to SEQ ID NO: 39710.

According to a particularly preferred embodiment the RNA sequence according to the invention comprises, preferably in 5'- to 3'-direction:

a) a 5'-cap structure (cap0, cap1, cap2), preferably m7GpppN;
b) a 5'-UTR element which comprises or consists of a nucleic acid sequence corresponding to a nucleic acid sequence according to SEQ ID NO: 39691, or SEQ ID NO: 39692, or SEQ ID NO: 39693, or SEQ ID NO: 39694, a homolog, a fragment or a variant thereof;
c) at least one coding sequence according to any one of SEQ ID NOs: 8821-39690, 39717, and/or 39730 or a variant or fragment thereof encoding at least one antigenic peptide or protein derived from a Norovirus protein or peptide or a fragment or variant thereof according to any one of SEQ ID NOs: 1-4410, preferably comprising or consisting of any one of the nucleic acid sequences according to, or a fragment or variant thereof,
d) a 3'-UTR element comprising or consisting of a nucleic acid sequence which is derived from a gene providing a stable RNA, preferably comprising or consisting of the corresponding to a nucleic acid sequence according to SEQ ID NO: 39707, or SEQ ID NO: 39708, or SEQ ID NO: 39703, or SEQ ID NO: 39704, a homolog, a fragment or a variant thereof;
e) optionally, a poly(A) sequence preferably comprising 64 adenosines; and
f) optionally, a poly(C) sequence, preferably comprising 3D cytosines.

More preferably, the artificial nucleic acid according to the invention comprises or consists of, preferably in 5' to 3' direction, the following elements:

a) optionally, a 5'-cap structure (cap0, cant cap2), preferably m7GpppN,
b) a 5'-UTR element, which comprises or consists of a nucleic acid sequence, which is derived from the 5'-UTR of a TOP gene, preferably comprising a nucleic acid sequence according to SEQ ID NO: 39691 to SEQ ID NO: 39694, or a homolog, a fragment or a variant thereof,
c) a coding sequence encoding at least one protein comprising at least one Norovirus protein as described herein, or a fragment or variant thereof,
d) a 3'-UTR element comprising a nucleic acid sequence, which is derived from an albumin gene, preferably comprising the corresponding RNA sequence of the nucleic acid sequence according to SEQ ID NO: 39705, or SEQ ID NO: 39706, or a homolog, a fragment or a variant thereof,
e) optionally a poly(A) tail, preferably consisting of 10 to 200, 10 to 100, 40 to 80 or 50 to 70 adenosine nucleotides,
f) optionally a poly(S) tail, preferably consisting of 10 to 200, 10 to 100, 20 to 70, 20 to 60 or 10 to 40 cytosine nucleotides, and
g) optionally a histone stem-loop, preferably comprising the RNA sequence according to SEQ ID NO: 39709 to SEQ ID NO: 39710.

In some embodiments, the at least one coding region of the artificial nucleic acid according to the present invention comprises a nucleic acid sequence encoding a molecular tag. More preferably, the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

In particularly preferred embodiments the mRNA sequence according to the invention comprises the following mRNA sequences (or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA sequences):

mRNA encoding VP1 protein of Norovirus GII.4.1131693-USA-2003; SEQ ID NO: 39713.
mRNA encoding VP1 protein of Norovirus GII.4-031693-USA-2003; SEQ ID NO: 39714.
mRNA encoding VP1 protein of Norovirus GII.4-031693-USA-2003; SEQ ID NO: 39715.
mRNA encoding VP1 protein of Norovirus GII.4-031693-USA-2003; SEQ ID NO: 39716.
mRNA encoding VP1 protein of Norovirus GII.4-031693-USA-2003; SEQ ID NO: 39717.
mRNA encoding VP1 protein of Norovirus GII.4 Farmington Hills-2002-USA; SEQ ID NO: 39718.
mRNA encoding VP1 protein of Norovirus GII.4 Farmington Hills-2002-USA; SEQ ID NO: 39719.
mRNA encoding VP1 protein of Norovirus GII.4 Farmington Hills-2002-USA; SEQ ID NO: 39720.
mRNA encoding VP1 protein of Norovirus GII.4 Farmington Hills-2002-USA; SEQ ID NO: 39721.
mRNA encoding VP1 protein of Norovirus GI.1-USA-1968; SEQ ID NO: 39722.

mRNA encoding VP1 protein of Norovirus GI.1-USA-1968; SEQ ID NO: 39723.

mRNA encoding VP1 protein of Norovirus GI.1-USA-1968; SEQ ID NO: 39724.

mRNA encoding VP1 protein of Norovirus GI.1-USA-1968; SEQ ID NO: 39725.

mRNA encoding VP1 protein of Norovirus GII.4 2006b 092895-USA-2008; SEQ ID NO: 39726.

mRNA encoding VP1 protein of Norovirus GII.4 2006b 092895-USA-2008; SEQ ID NO: 39727.

mRNA encoding VP1 protein of Norovirus GII.4 2006b 092895-USA-2008; SEQ ID NO: 39728.

mRNA encoding VP1 protein of Norovirus GII.4 2006b 092895-USA-2008; SEQ ID NO: 39729.

mRNA encoding VP1 protein of Norovirus GII.4 2006b 092895-USA-2008; SEQ ID NO: 39730.

mRNA encoding VP1 protein of Norovirus GII.4 GZ2010-L87-Guangzhou-2011; SEQ ID NO: 39731.

mRNA encoding VP1 protein of Norovirus GII.4 GZ2010-L87-Guangzhou-2011; SEQ ID NO: 39732.

mRNA encoding VP1 protein of Norovirus GII.4 GZ2010-L87-Guangzhou-2011; SEQ ID NO: 39733.

mRNA encoding VP1 protein of Norovirus GII.4 G2010-L87-Guangzhou-2011; SEQ ID NO: 39734.

mRNA encoding VP1 protein of Norovirus GII.4 USA-1997; SEQ ID NO: 39735.

mRNA encoding VP1 protein of Norovirus GII.4 USA-1997: SEQ ID NO: 39736.

mRNA encoding VP1 protein of Norovirus GII.4 USA-1997; SEQ ID NO: 39737.

mRNA encoding VP1 protein of Norovirus GII.4 USA-1997; SEQ ID NO: 39738.

mRNA encoding VP1 protein of Norovirus Melksham; SEQ ID NO: 39739.

mRNA encoding VP1 protein of Norovirus Melksham; SEQ ID NO: 39740.

mRNA encoding VP1 protein of Norovirus Melksham; SEQ ID NO: 39741.

mRNA encoding VP1 protein of Norovirus Melksham; SEQ ID NO: 39742.

mRNA encoding VP1 protein of Norovirus GII.2-Vaals87-2005-NL; SEQ ID NO: 39743.

mRNA encoding VP1 protein of Norovirus GII.2-Vaals87-2005-NL; SEQ ID NO: 39744.

mRNA encoding VP1 protein of Norovirus GII.2-Vaals87-2005-NL; SEQ ID NO: 39745.

mRNA encoding VP1 protein of Norovirus GII.2-Vaals87-2005-NL; SEQ ID NO: 39746.

RNA Production:

The artificial nucleic acid according to the invention may be prepared by using any suitable method known in the art, including synthetic methods such as e.g. solid phase synthesis, as well as recombinant and in vitro methods, such as in vitro transcription reactions.

In a preferred embodiment, a linear DNA template is transcribed in vitro using DNA dependent T7 RNA polymerase in the presence of a nucleotide mixture and cap analog (m7GpppG) under suitable buffer conditions. In a particularly preferred embodiment, RNA production is performed under current good manufacturing practice, implementing various quality control steps, e.g. according to WO 2016/180430. The obtained RNAs are HPLC purified using PureMessenger® (CureVac, Tübingen, Germany; WO 2008/077592). In a preferred embodiment, purified RNA product is lyophilized according to WO 2016/165831 to yield a temperature stable Norovirus artificial nucleic acid. For the production of polyvalent Norovirus compositions, methods as disclosed in the PCT application PCT/EP2016/082487 are preferably used and adapted accordingly.

Composition:

In a further aspect, the present invention provides a composition comprising at least one artificial nucleic acid as described herein and a suitable carrier, preferably a pharmaceutically acceptable carrier. The inventive composition comprising the artificial nucleic acid as described herein is preferably a (pharmaceutical) composition or a vaccine as described herein.

The inventive composition may comprise either only one type of artificial nucleic acid or at least two different artificial nucleic acids. In particular, the inventive composition may comprise at least two artificial nucleic acids as described herein, wherein each of the at least two artificial nucleic acids comprises at least one coding region encoding at least one polypeptide comprising a different one of the Norovirus proteins as described herein, or a fragment or a variant of any one of these proteins. Alternatively, the composition may comprise at least two artificial nucleic acids as described herein, wherein each of the at least two artificial nucleic acids comprises at least one coding region encoding at least one polypeptide comprising at least two different Norovirus proteins as described herein, or a fragment or a variant of any one of these proteins. In another embodiment, the composition may also comprise at least two different artificial nucleic acids, which are bi- or multicistronic nucleic acids as described herein and wherein each of the artificial nucleic acids encodes at least two polypeptides, each comprising at least one Norovirus protein, or a fragment or variant thereof.

Preferably, the inventive composition comprises or consists of at least one artificial nucleic acid as described herein and a pharmaceutically acceptable carrier. The expression "pharmaceutically acceptable carrier" as used herein preferably includes the liquid or non-liquid basis of the inventive composition, which is preferably a pharmaceutical composition or a vaccine. If the inventive composition is provided in liquid form, the carrier will preferably be water, typically pyrogen-free water; isotonic saline or buffered (aqueous) solutions, e.g phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCL, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, CaIz, $CaBr_2$, $CaCO_3$, $CaSO_4$, $Ca(OH)_2$. Furthermore, organic anions of the aforementioned cations may be contained in the buffer.

Furthermore, one or more compatible solid or liquid fillers or diluents or encapsulating compounds may be used as well, which are suitable for administration to a person. The term "compatible" as used herein means that the constituents of the inventive composition are capable of being mixed with the at least one artificial nucleic acid of the composition, in such a manner that no interaction occurs, which would substantially reduce the biological activity or the pharmaceutical effectiveness of the inventive composition under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid gliddants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

Further additives which may be included in the inventive composition are emulsifiers, such as, far example, Tween; wetting agents, such as, for example, sodium lauryl sulfate; colouring agents; taste-imparting agents, pharmaceutical carriers; tablet-forming agents; stabilizers; antioxidants; preservatives.

In another embodiment, the composition of the invention comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids of the invention, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids of the invention comprises at least one coding region encoding at least one polypeptide comprising a Norovirus protein, and/or a fragment or a variant of any one of these proteins, wherein each coding region preferably encodes a different Norovirus protein, more preferably each coding region encodes a capsid protein, preferably VP1 of a different Norovirus.

In another embodiment, the composition of the invention comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 5051, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids of the invention, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 5051, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids of the invention comprises at least one coding region encoding at least one polypeptide comprising at least two different Norovirus proteins, preferably VP1 and VP2, and/or a fragment or a variant of any one of these proteins.

In a preferred embodiment, the inventive composition, which is preferably a pharmaceutical composition or a vaccine, comprises at least one artificial nucleic acid as described herein, wherein the at least one artificial nucleic acid is complexed at least partially with a cationic or polycationic compound and/or a polymeric carrier, preferably a cationic protein or peptide. Accordingly, in a further embodiment of the invention it is preferred that the at least one artificial nucleic acid as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of the artificial nucleic acid or any other nucleic acid to cationic or polycationic compound and/or with a polymeric carrier: or optionally in a nitrogen/phosphate (NIP) ratio of the artificial nucleic acid or any other nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one artificial nucleic acid to the one or more polycations is in the range of about 0.1 to 10, including a range of about 0.3 to 4, of about 0.5 to 2, of about 0.7 to 2 and of about 0.7 to 1.5.

In another embodiment, the composition comprising at least one artificial nucleic acid of the invention is defined as follows:

(i) the ratio of complexed nucleic acid to free nucleic acid is selected from a range of about 5:1 (w/w) to about 1:10 (w/w), more preferably from a range of about 4:1 (w/w) to about 1:3 (w/w), even more preferably from a range of about 3:1 (w/w) to about 1:5 (w/w) or 1:3 (w/w), wherein the ratio is most preferably about 1:1 (w/w): or (ii) the mRNA is complexed with one or more cationic or polycationic compounds in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w:w) or of about 3:1 (w/w) to about 1:1 (w/w), and most preferably a ratio of about 3:1 (w/w) to about 2:1 (w/w) of mRNA to cationic or polycationic compound and/or with a polymeric carrier: or optionally in a nitrogen/phosphate ratio of mRNA to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9;

and/or wherein the at least one artificial nucleic acid or mRNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids and/or wherein the at least one artificial nucleic acid or mRNA is complexed with one or more lipids and thereby forming liposomes, lipid nanoparticles and/or lipoplexes.

Preferably, the inventive composition comprises at least one artificial nucleic acid as described herein, which is complexed with one or more polycations and/or a polymeric carrier, and at least one free nucleic acid, wherein the at least one complexed nucleic acid is preferably identical to the at least one artificial nucleic acid according to the present invention. In this context it is particularly preferred that the at least one artificial nucleic acid of the inventive composition is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the inventive artificial nucleic acid is complexed with a cationic compound and that the rest of the inventive artificial nucleic acid is (comprised in the inventive pharmaceutical composition or vaccine) in uncomplexed form ("free").

In a further embodiment, the composition of the invention comprises (i) at least 2, 3, 4, 5, 6, 7, 8, 9, 10 or more artificial nucleic acids as defined in the invention; or (ii) at least 10, 15, 20 or 50 artificial nucleic acids as defined in the invention; or (iii) 2-10, 10-15, 15-20, 20-50, 50-100 or 100-200 artificial nucleic acids as defined in the invention; and a pharmaceutically acceptable carrier.

In one embodiment, the compositions and/or vaccines of the invention comprise artificial nucleic acids encoding one or more capsid proteins VP1 derived from one or more Noroviruses. In another embodiment, the compositions and/or vaccines of the invention comprise artificial nucleic acids encoding one or more capsid proteins VP2 derived from one or more Noroviruses.

In another embodiment, the composition of the invention is further defined as composition, wherein (i) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 50, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI Noroviruses; or (ii) the artificial nucleic acids are derived from a single GII Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 56, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GIII Noroviruses; or (iii) the artificial nucleic acids are derived from a single GIII Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or mare different GIII Noroviruses; or (iv) the artificial nucleic acids are derived from a single GIV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GIV Noroviruses; or (v) the artificial nucleic acids are derived from a single GV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 59, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GV Noroviruses; or (vi) the artificial nucleic acids are derived from a single GI Norovirus and additionally from a single GII Norovirus, GIII Norovirus, GIV Norovirus and/or GU Norovirus; or (vii) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or mare different GI Noroviruses and additionally from a single 911, GIII, GIV or GV Norovirus and/or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 and/or mare GII, GIII, GIV or GV Noroviruses.

In a further embodiment, the composition of the invention further is defined as composition, wherein (i) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI.1 Noroviruses; or (ii) the artificial nucleic acids are derived from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GII.4 Noroviruses; or (iii) the artificial nucleic acids are derived from a single GI.1 Norovirus and additionally from a single GII.4 Norovirus; or (iv) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI.1 Noroviruses and additionally from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more GII.4 Noroviruses.

In a further embodiment, the composition of the invention further is defined as composition, wherein (i) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or mare different GII.4 Noroviruses; or (ii) the artificial nucleic acids are derived from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GII.4 Noroviruses; or (iii) the artificial nucleic acids are derived from a single GI.1 Norovirus and additionally from a single GII.4 Norovirus; or (iv) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI.1 Noroviruses and additionally from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more GII.4 Noroviruses; and/or wherein (i) at least one of the nucleic acid sequences according to any one of SEQ ID NOs: 4411-39690, 39713-39746; and/or (ii) at least one of the nucleic acid sequences having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the nucleic acid sequence represented by any one of SEQ ID NOs: 4411-39690, 39713-39746; and/or (iii) at least one complement of the nucleic acid sequences which are capable of hybridizing with a nucleic acid sequence comprising a sequence as shown in SEQ ID NDs: 4411-39690, 39713-39746, and/or (iv) an orthologue or a paralogue of any one of SEQ ID NOs: 4411-39690, 39713-39746; and/or a fragment or variant of any of these sequences.

and/or wherein (i) at least one of the nucleic acid sequences according to any one of SEQ ID NO: 39713 to SEQ ID NO: 39746; and/or (ii) at least one of the nucleic acid sequences having, in increasing order of preference, at least 50%, 51%, 52%, 53%, 54%, 55%, 56%, 57%, 58%, 59%, 60%, 61%, 62%, 63%, 64%, 65%, 68%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the nucleic acid sequence represented by any one of SEQ ID NO: 39713 to SEQ ID NO: 39746; and/or (iii) at least one complement of the nucleic acid sequences which are capable of hybridizing with a nucleic acid sequence comprising a sequence as shown in SEQ ID NO: 39713 to SEQ ID NO: 39746; and/or (iv) an orthologue or a paralogue of any one of SEQ ID NO: 39713 to SEQ ID NO: 39746; and/or a fragment or variant of any of these sequences.

In a preferred embodiment, the composition of the invention further is defined as a composition comprising two different nucleic acid sequences (bivalent, divalent composition), wherein one of the two different nucleic acid sequences is derived from Norovirus GII.4 and one of the two different nucleic acid sequence is derived from Norovirus GI.1, wherein the one nucleic acid sequence of Norovirus 811.4 may be any one of the nucleic acid sequences as defined herein and in Table 1, or fragment or variants of these sequences, and wherein the one nucleic acid sequence of Norovirus GI.1 may be any one of the nucleic acid sequences as defined herein and in Table 1, or fragment or variants of these sequences. Preferably, the composition comprising two different nucleic acid sequences (bivalent, divalent composition) comprises or consists of one nucleic acid sequence derived from Norovirus GII.4 selected from SEQ ID NOs: 39713-39721, 39726-39742, and one nucleic acid sequence derived from Norovirus GI.1 selected from SEQ ID NDs: 39722-39725.

In a specific preferred embodiment, the composition comprising two different nucleic acid sequences (bivalent, divalent composition) comprises or consists of the nucleic acid sequences SEQ ID NO: 39716 (Norovirus GII.4) and SEQ ID NO: 39725 (Norovirus GI.1). In a further specific preferred embodiment, the composition comprising two different nucleic acid sequences (bivalent, divalent composition) comprises or consists of the nucleic acid sequences SEQ ID NO: 39721 (Norovirus GII.4) and SEQ ID NO: 39725 (Norovirus GI.1). In a further specific preferred embodiment, the composition comprising two different nucleic acid sequences (bivalent, divalent composition) comprises or consists of the nucleic acid sequences SEQ ID NO: 39729 (Norovirus GII.4) and SEQ ID NO: 39725 (Norovirus GI.1). In a further specific preferred embodiment, the composition comprising two different nucleic acid sequences (bivalent, divalent composition) comprises or consists of the nucleic acid sequences SEQ ID NO: 39734 (Norovirus GII.4) and SEQ ID NO: 39725 (Norovirus GI.1). In a further specific preferred embodiment, the composition comprising two different nucleic acid sequences (bivalent, divalent composition) comprises or consists of the nucleic acid sequences SEQ ID NO: 39738 (Norovirus 811.4) and SEQ ID NO: 39725 (Norovirus GI.1).

In a preferred embodiment, the composition of the invention further is defined as a composition comprising two different nucleic acid sequences (bivalent, divalent composition) derived from Norovirus GII.4, wherein the two different nucleic acid sequences of Norovirus GII.4 may be any one of the nucleic acid sequences as defined herein and in Table 1, or fragment or variants of these sequences. Preferably, the composition comprising two different nucleic acid sequences derived from Norovirus GII.4 (bivalent, divalent composition) comprises or consists of one nucleic acid sequence selected from SEQ ID NOs: 39713-39721, 39726-39742.

In a specific preferred embodiment, the composition comprising two different nucleic acid sequences (bivalent, divalent composition) comprises or consists of the nucleic acid sequences SEQ ID NO: 39716 (Norovirus GII.4) and SEQ ID NO: 39721 (Norovirus GII.4). In a specific preferred embodiment, the composition comprising two different nucleic acid sequences (bivalent, divalent composition) comprises or consists of the nucleic acid sequences SEQ ID NO: 39729 (Norovirus GII.4) and SEQ ID NO: 39721 (Norovirus GII.4). In a specific preferred embodiment, the composition comprising two different nucleic acid sequences (bivalent, divalent composition) comprises or consists of the nucleic acid sequences SEQ ID NO: 39734 (Norovirus GII.4) and SEQ ID NO: 39721 (Norovirus GII.4). In a specific preferred embodiment, the composition comprising two different nucleic acid sequences (bivalent, divalent composition) comprises or consists of the nucleic acid sequences SEQ ID NO: 39738 (Norovirus GII.4) and SEQ ID NO: 39721 (Norovirus GII.4). In a specific preferred embodiment, the composition comprising two different nucleic acid sequences (bivalent, divalent composition) comprises or consists of the nucleic acid sequences SEQ ID NO: 39716 (Norovirus GII.4) and SEQ ID NO: 39729 (Norovirus GII.4). In a specific preferred embodiment, the composition comprising two different nucleic acid sequences (bivalent, divalent composition) comprises or consists of the nucleic acid sequences SEQ ID NO: 39734 (Norovirus GII.4) and SEQ ID NO: 39729 (Norovirus GII.4). In a specific preferred embodiment, the composition comprising two different nucleic acid sequences (bivalent, divalent composition) comprises or consists of the nucleic acid sequences SEQ ID NO: 39738 (Norovirus GII.4) and SEQ ID NO: 39729 (Norovirus GII.4). In a specific preferred embodiment, the composition comprising two different nucleic acid sequences (bivalent, divalent composition) comprises or consists of the nucleic acid sequences SEQ ID NO: 39719 (Norovirus GII.4) and SEQ ID NO: 39734 (Norovirus GII.4). In a specific preferred embodiment, the composition comprising two different nucleic acid sequences (bivalent, divalent composition) comprises or consists of the nucleic acid sequences SEQ ID NO: 39738 (Norovirus GII.4) and SEQ ID NO: 39734 (Norovirus GII.4). In a specific preferred embodiment, the composition comprising two different nucleic acid sequences (bivalent, divalent composition) comprises or consists of the nucleic acid sequences SEQ ID NO: 39719 (Norovirus GII.4) and SEQ ID NO: 39738 (Norovirus GII.4).

In further a preferred embodiment, the composition of the invention further is defined as a composition comprising four different nucleic acid sequences (tetravalent composition), wherein each of the four different nucleic acid sequences is derived from Norovirus GII.4, wherein each of the four different nucleic of Norovirus GII.4 may be any one of the nucleic acid sequences as defined herein and in Table 1, or fragment or variants of these sequences. Preferably, the composition comprising four different nucleic acid sequences (tetravalent composition) comprises or consists of four nucleic acid sequence derived from Norovirus GII.4 selected from SEQ ID NOs: 39713-39721, 39726-39742.

In a specific preferred embodiment, the composition comprising four different nucleic acid sequences (tetravalent composition) comprises four of the nucleic acid sequences selected from SEQ ID NOs: 39716, 39721, 39729, 39734 or 39738.

In a further preferred embodiment, the composition of the invention is defined as a composition comprising four different nucleic acid sequences (tetravalent composition), wherein at least one of the four different nucleic acid sequences is derived from Norovirus GII.4 and at least one of the four different nucleic acid sequence is derived from Norovirus GI.1, wherein the at least one of the four different nucleic of Norovirus GII.4 may be any one of the nucleic acid sequences as defined herein and in Table 1, or fragment or variants of these sequences, and wherein the at least one of the four of nucleic acid sequence of Norovirus GI.1 may be any one of the nucleic acid sequences as defined herein and in Table 1, or fragment or variants of these sequences.

In a further preferred embodiment, the composition of the invention is defined as a composition comprising four different nucleic acid sequences (tetravalent composition), wherein three of the four different nucleic acid sequences are derived from Norovirus GII.4 and one of the four different nucleic acid sequence is derived from Norovirus GI.1, wherein the three of the four different nucleic of Norovirus GII.4 may be any one of the nucleic acid sequences as defined in Table 1, or fragment or variants of these sequences, and wherein the one of the four of nucleic acid sequence of Norovirus GI.1 may be any one of the nucleic acid sequences as defined in Table 1, or fragment or variants of these sequences. Preferably, the composition comprising four different nucleic acid sequences (tetravalent composition) comprises or consists of three nucleic acid sequence derived from Norovirus GII.4 selected from SEQ ID NOs: 39713-39721, 39726-39742 and one nucleic acid sequence derived from Norovirus GI.1 SEQ ID NOs: 39722-39725.

In a specific preferred embodiment, the composition comprising four different nucleic acid sequences (tetravalent composition) comprises three of the nucleic acid sequences derived from Norovirus GII.4 selected from SEQ ID NOs: 39716, 39721, 39729, 39734 or 39738 and one nucleic acid sequence derived from Norovirus GI.1 SEQ ID NO: 39725.

In further a preferred embodiments, the composition of the invention is defined as a composition comprising multiple different nucleic acid sequences (multivalent composition) defined as a composition comprising 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 different nucleic acid sequences derived from Norovirus GI.1, Norovirus GI.2, Norovirus GI.3, Norovirus GI.4, Norovirus GI.5, Norovirus GI.6, Norovirus GI.7, Norovirus GI.8, Norovirus GI.9, Norovirus GII.1, Norovirus GII.2, Norovirus GII.3, Norovirus GII.4, Norovirus GII.5, Norovirus GII.6, Norovirus GII.7, Norovirus GII.11, Norovirus GII.12, Norovirus GII.13, Norovirus GII.14, Norovirus GII.15, Norovirus GII.16, Norovirus GII.17, Norovirus GII.21, Norovirus GIII.1, Norovirus GV.1 or Norovirus GIV.1.

In further a preferred embodiments, the composition of the invention is defined as a composition comprising multiple different nucleic acid sequences (multivalent composition) defined as a composition comprising 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 different nucleic acid sequences selected from Table 3 (column 4 and column 5). In Table 3, each row (row 1-row 138) corresponds to selected Norovirus protein or antigen as identified by the respective name (first column, column 1 "Strain/Isolate") and the database accession number of the corresponding protein (second column, column 2 "NCBI or Genbank Accession No."). The third column, column 3 ("A") in Table 3 indicates the SEQ ID NOs corresponding to the respective amino acid sequence as provided herein. The SEQ ID NOs corresponding to the nucleic acid sequence of the wild type nucleic acid sequence encoding the Norovirus protein or peptide is indicated in the fourth column, column 4 ("B"). The fifth column, column 5 ("C") provides the SEQ ID NOs corresponding to modified nucleic acid sequences of the nucleic acid sequences as described herein that encode the Norovirus protein or peptide preferably having the amino acid sequence as defined by the SEQ ID NOs indicated in the third column ("A") or by the database entry indicated in the second column ("14981 or Genbank Accession No.").

TABLE 3

Selected VP1 Norovirus sequences (row 1-row 138)

| Row | column 1 Strain/Isolate | column 2 NCBI or Genbank Accession No. | column 3 A | column 4 B | column 5 C |
|---|---|---|---|---|---|
| 1 | Norovirus Hu/GII.4/Dijon/E872/2002/FRA | AC055068 | 2 | 4412 | 8822, 13232, 17642, 22052, 26462, 30872, 35282 |
| 2 | Norovirus Hu/GII.4/MD120-12/1987/USA | AFS33552 | 16 | 4426 | 8836, 13246, 17656, 22066, 26476, 30886, 35296 |
| 3 | Norovirus Hu/GII.1/7EK/Hawaii/1971/USA | AFS33555 | 17 | 4427 | 8837, 13247, 17657, 22067, 26477, 30887, 35297 |
| 4 | Norovirus Hu/GII.6/CHDC4073/1984/USA | AFX71665 | 27 | 4437 | 8847, 13257, 17667, 22077, 26487, 30897, 35307 |
| 5 | Norovirus Hu/GII.4/Hiroshima/19/2001/JPN | BAI49904 | 327 | 4737 | 9147, 13557, 17967, 22377, 26787, 31197, 35607 |
| 6 | Norovirus Hu/GII.4/Hiroshima/67/2006/JPN | BAI49914 | 335 | 4745 | 9155, 13565, 17975, 22385, 26795, 31205, 35615 |
| 7 | Norovirus Hu/GII/JP/2015/GII.Pe_GII.4/Osaka/OSF78 | BAS02083 | 364 | 4774 | 9184, 13594, 18004, 22414, 26824, 31234, 35644 |
| 8 | Norovirus GII/Hu/NL/2012/GII.4/Groningen | CRL46958 | 367 | 4777 | 9187, 13597, 18007, 22417, 26827, 31237, 35647 |
| 9 | Norovirus GII/Hu/NL/2014/GII.2/Groningen | CRL46973 | 372 | 4782 | 9192, 13602, 18012, 22422, 26832, 31242, 35652 |
| 10 | Norovirus Hu/GII.4/New Orleans1500/2008/USA | ADB27027 | 376 | 4786 | 9196, 13606, 18016, 22426, 26836, 31246, 35656 |
| 11 | Norovirus Hu/GII.6/Ohio/490/2012/USA | AGI96397 | 386 | 4796 | 9206, 13616, 18026, 22436, 26846, 31256, 35666 |
| 12 | Norovirus Hu/GII.3/Jingzhou/2013402/CHN | AGX01095 | 391 | 4801 | 9211, 13621, 18031, 22441, 26851, 31261, 35671 |
| 13 | Norovirus Hu/GII.4/Jingzhou/2013403/CHN | AGX01098 | 392 | 4802 | 9212, 13622, 18032, 22442, 26852, 31262, 35672 |
| 14 | Norovirus Hu/GII.17/Gaithersburg/2014/US | AKI30060 | 393 | 4803 | 9213, 13623, 18033, 22443, 26853, 31263, 35673 |
| 15 | Norovirus Hu/GII.4/C127/GF/1978 | AGL98413 | 404 | 4814 | 9224, 13634, 18044, 22454, 26864, 31274, 35684 |
| 16 | Norovirus Hu/GII.4/CHDC3967/1988/US | ACT76145 | 458 | 4868 | 9278, 13688, 18098, 22508, 26918, 31328, 35738 |
| 17 | Norovirus Hu/GII.4/CHDC4108/1987/US | ACT76148 | 459 | 4869 | 9279, 13689, 18099, 22509, 26919, 31329, 35739 |
| 18 | Norovirus Hu/GII.4/CHDC4871/1977/US | ACT76151 | 460 | 4870 | 9280, 13690, 18100, 22510, 26920, 31330, 35740 |
| 19 | Norovirus Hu/GII.3/CHDC5261/1990/US | AED02034 | 501 | 4911 | 9321, 13731, 18141, 22551, 26961, 31371, 35781 |
| 20 | Norovirus Hu/GII.3/Milwaukee009/2010/USA | AEX10549 | 534 | 4944 | 9354, 13764, 18174, 22584, 26994, 31404, 35814 |
| 21 | Norovirus Hu/GII.4/Miranda/NSW817L/2010/AU | AFJ2I448 | 597 | 5007 | 9417, 13827, 18237, 22647, 27057, 31467, 35877 |
| 22 | Norovirus Hu/GII.2/KL109/MY/1978 | AFN06726 | 603 | 5013 | 9423, 13833, 18243, 22653, 27063, 31473, 35883 |
| 23 | Norovirus Hu/GII.14/HK74/CN/1978 | AFN06727 | 604 | 5014 | 9424, 13834, 18244, 22654, 27064, 31474, 35884 |
| 24 | Norovirus Hu/GII.7/HK4/CN/1976 | AFN06731 | 608 | 5018 | 9428, 13838, 18248, 22658, 27068, 31478, 35888 |
| 25 | Norovirus Hu/GII.17/C142/GF/1978 | AFN06732 | 609 | 5019 | 9429, 13839, 18249, 22659, 27069, 31479, 35889 |
| 26 | Norovirus Hu/GII.5/C15/GF/1978 | AFN06733 | 610 | 5020 | 9430, 13840, 18250, 22660, 27070, 31480, 35890 |
| 27 | Norovirus Hu/GI.5/E57/UG/1975 | AFN06735 | 612 | 5022 | 9432, 13842, 18252, 22662, 27072, 31482, 35892 |
| 28 | Norovirus Hu/GII.4/Randwick/NSW882J/2011/AU | AFV08771 | 616 | 5026 | 9436, 13846, 18256, 22666, 27076, 31486, 35896 |

TABLE 3-continued

Selected VP1 Norovirus sequences (row 1-row 138)

| Row | column 1 Strain/Isolate | column 2 NCBI or Genbank Accession No. | column 3 A | column 4 B | column 5 C |
|---|---|---|---|---|---|
| 29 | Norovirus Hu/GII.4/Berowra/NSW767L/2012/AU | AFV08777 | 618 | 5028 | 9438, 13848, 18258, 22668, 27078, 31488, 35898 |
| 30 | Norovirus Hu/GII.4/Sydney/NSW0514/2012/AU | AFV08795 | 624 | 5034 | 9444, 13854, 18264, 22674, 27084, 31494, 35904 |
| 31 | Norovirus Hu/GII.4/Hong Kong/CUHK3630/2012/CHN | AFX95940 | 625 | 5035 | 9445, 13855, 18265, 22675, 27085, 31495, 35905 |
| 32 | Norovirus Hu/GII.4/VP1172/Shanghai/2012/CHN | AGI99552 | 629 | 5039 | 9449, 13859, 18269, 22679, 27089, 31499, 35909 |
| 33 | Norovirus Hu/GII-4/New Taipei/CGMH61/2012/TW | AGK25912 | 644 | 5054 | 9464, 13874, 18284, 22694, 27104, 31514, 35924 |
| 34 | Norovirus GII/Hu/HKG/2013/GII.4/CUHK-NS-141 | AID68581 | 859 | 5269 | 9679, 14089, 18499, 22909, 27319, 31729, 36139 |
| 35 | Norovirus GII/Hu/JP/2002/GII.P12_GII.13/Saitama/T80 | AII73717 | 877 | 5287 | 9697, 14107, 18517, 22927, 27337, 31747, 36157 |
| 36 | Norovirus GII/Hu/JP/2001/GII.P12_GII.12/Saitama/T15 | AII73735 | 883 | 5293 | 9703, 14113, 18523, 22933, 27343, 31753, 36163 |
| 37 | Norovirus GII/Hu/JP/2007/GII.P21_GII.21/Kawasaki/Y0284 | AII73741 | 885 | 5295 | 9705, 14115, 18525, 22935, 27345, 31755, 36165 |
| 38 | Norovirus GII/Hu/JP/2007/GII.P15_GII.15/Sapporo/HK299 | AII73759 | 891 | 5301 | 9711, 14121, 18531, 22941, 27351, 31761, 36171 |
| 39 | Norovirus GI/Hu/JP/2007/GI.P3_GI.3/Shimizu/KK2866 | AII73765 | 893 | 5303 | 9713, 14123, 18533, 22943, 27353, 31763, 36173 |
| 40 | Norovirus GII/Hu/JP/2007/GII.P7_GII.14/Fukuoka/KK282 | AII73780 | 898 | 5308 | 9718, 14128, 18538, 22948, 27358, 31768, 36178 |
| 41 | Norovirus GI/Hu/JP/2007/GI.P8_GI.8/Nagoya/KY531 | AII73783 | 899 | 5309 | 9719, 14129, 18539, 22949, 27359, 31769, 36179 |
| 42 | Norovirus Hu/GII.4/SJTUH1/CHN/2014 | AIS40019 | 901 | 5311 | 9721, 14131, 18541, 22951, 27361, 31771, 36181 |
| 43 | Norovirus Hu/GII.4/variant Sydney 2012/FRA | AIY27747 | 930 | 5340 | 9750, 14160, 18570, 22980, 27390, 31800, 36210 |
| 44 | Norovirus Hu/GII-4/Hokkaido4/2006/JP | BAG70437 | 1033 | 5443 | 9853, 14263, 18673, 23083, 27493, 31903, 36313 |
| 45 | Norovirus GIV/Hu/Jp/2001/GIV.1/OCO1017023 | BAU16306 | 1345 | 5755 | 10165, 14575, 18985, 23395, 27805, 32215, 36625 |
| 46 | Norovirus Hu/GII.4/Beijing/53671/2007/CHN | ACY00615 | 1454 | 5864 | 10274, 14684, 19094, 23504, 27914, 32324, 36734 |
| 47 | Norovirus Hu/II.4/2200661/HK/2010 | ADK47170 | 1467 | 5877 | 10287, 14697, 19107, 23517, 27927, 32337, 36747 |
| 48 | Norovirus Hu/GII.4/Aichi368-14/2014 | BAQ20801 | 1477 | 5887 | 10297, 14707, 19117, 23527, 27937, 32347, 36757 |
| 49 | Norovirus Hu/GII.4/Hunter 284E/040/AU | AAZ31376 | 1552 | 5962 | 10372, 14782, 19192, 23602, 28012, 32422, 36832 |
| 50 | Norovirus Hu/GII-4/Osaka/1998/JPN | ABI97981 | 1569 | 5979 | 10389, 14799, 19209, 23619, 28029, 32439, 36849 |
| 51 | Norovirus Hu/GI.1/P774.Delsjo2004/Gothenburg/Sweden | ABW74128 | 1610 | 6020 | 10430, 14840, 19250, 23660, 28070, 32480, 36890 |
| 52 | Norovirus pig/GII.11/F18-10/2005/CAN | ACC69023 | 1629 | 6039 | 10449, 14859, 19269, 23679, 28089, 32499, 36909 |
| 53 | Norovirus Hu/GII.4/Wellington/1995/USA | ACL27297 | 1670 | 6080 | 10490, 14900, 19310, 23720, 28130, 32540, 36950 |
| 54 | Norovirus Hu/GII.4/Henry/2000/USA | ACL27298 | 1671 | 6081 | 10491, 14901, 19311, 23721, 28131, 32541, 36951 |
| 55 | Norovirus Hu/GII.4/SSCS/2005/USA | ACL27299 | 1672 | 6082 | 10492, 14902, 19312, 23722, 28132, 32542, 36952 |
| 56 | Norovirus GII/Hu/IN/2006/GII.P4_GII.4_Yerseke2006a/Pune-PC21 | ACL31322 | 1680 | 6090 | 10500, 14910, 19320, 23730, 28140, 32550, 36960 |
| 57 | Norovirus Hu/GI.1/P7-587/2007/Stromstad/Sweden | ACN32270 | 1692 | 6102 | 10512, 14922, 19332, 23742, 28152, 32562, 36972 |
| 58 | Norovirus Hu/GI.2/Leuven/2003/BEL | ACU56258 | 1698 | 6108 | 10518, 14928, 19338, 23748, 28158, 32568, 36978 |
| 59 | Norovirus Hu/GII.7/NSW743L/2008/AUS | ACX85810 | 1712 | 6122 | 10532.14942, 19352, 23762, 28172, 32582, 36992 |
| 60 | Norovirus Hu/GII.2/NF2002/USA/2002 | AFB18010 | 1731 | 6141 | 10551, 14961, 19371, 23781, 28191, 32601, 37011 |
| 61 | Norovirus Hu/GII.4/NF2003/USA/2003 | AFB18013 | 1732 | 6142 | 10552, 14962, 19372, 23782, 28192, 32602, 37012 |
| 62 | Norovirus Hu/GII.3/1999 | AFK75854 | 1739 | 6149 | 10559, 14969, 19379, 23789, 28199, 32609, 37019 |
| 63 | Norovirus Hu/GIV.1/Ahrenshoop246/DEU/2012 | AFN61315 | 1740 | 6150 | 10560, 14970, 19380, 23790, 28200, 32610, 37020 |
| 64 | Norovirus Hu/GII.4/Xi'an/P19/2010/CHN | AFQ00511 | 1741 | 6151 | 10561, 14971, 19381, 23791, 28201, 32611, 37021 |

TABLE 3-continued

Selected VP1 Norovirus sequences (row 1-row 138)

| Row | column 1 Strain/Isolate | column 2 NCBI or Genbank Accession No. | column 3 A | column 4 B | column 5 C |
|---|---|---|---|---|---|
| 65 | Norovirus Hu/GII.4/PA363/2011/ITA | AHC12655 | 1770 | 6180 | 10590, 15000, 19410, 23820, 28230, 32640, 37050 |
| 66 | Norovirus Hu/GII.4/P3/2012/Gothenburg/Sweden | AHZ12912 | 1778 | 6188 | 10598, 15008, 19418, 23828, 28238, 32648, 37058 |
| 67 | Norovirus Hu/GII.4/Tanger/TM687/2011/MAR | AIC32559 | 1787 | 6197 | 10607, 15017, 19427, 23837, 28247, 32657, 37067 |
| 68 | Norovirus 12-X-2/2012/GII.P22/GII.5 | AID51489 | 1793 | 6203 | 10613, 15023, 19433, 23843, 28253, 32663, 37073 |
| 69 | Norovirus Hu/GII.4/Kobe034/2006/JP | BAF45861 | 1826 | 6236 | 10646, 15056, 19466, 23876, 28286, 32696, 37106 |
| 70 | Norovirus Hu/GGII.4/Tiel001/1995/NL | BAF74508 | 1827 | 6237 | 10647, 15057, 19467, 23877, 28287, 32697, 37107 |
| 71 | Norovirus Hu/GGII.4/DenHaag015/2000/NL | BAF74509 | 1828 | 6238 | 10648, 15058, 19468, 23878, 28288, 32698, 37108 |
| 72 | Norovirus Hu/GGII.4/Schiedam018/2001/NL | BAF74512 | 1831 | 6241 | 10651, 15061, 19471, 23881, 28291, 32701, 37111 |
| 73 | Norovirus Hu/GGII.4/Apeldoorn023/2003/NL | BAF74517 | 1836 | 6246 | 10656, 15066, 19476, 23886, 28296, 32706, 37116 |
| 74 | Norovirus Hu/GGII.4/Middelburg007/2004/NL | BAF74521 | 1840 | 6250 | 10660, 15070, 19480, 23890, 28300, 32710, 37120 |
| 75 | Norovirus Hu/GII-4/Matsudo/021071/2002/JP | BAF95499 | 1847 | 6257 | 10667, 15077, 19487, 23897, 28307, 32717, 37127 |
| 76 | Norovirus Hu/GII-4/Kaiso/030556/2003/JP | BAF95501 | 1848 | 6258 | 10668, 15078, 19488, 23898, 28308, 32718, 37128 |
| 77 | Norovirus Hu/GII-4/Awa/040354/2004/JP | BAF95505 | 1850 | 6260 | 10670, 15080, 19490, 23900, 28310, 32720, 37130 |
| 78 | Norovirus Hu/GII.4/Apeldoorn3l7/2007/NL | BAG55289 | 1885 | 6295 | 10705, 15115, 19525, 23935, 28345, 32755, 37165 |
| 79 | Norovirus Hu/GII.2/Rotterdam39E/2002/NL | BAG68713 | 1891 | 6301 | 10711, 15121, 19531, 23941, 28351, 32761, 37171 |
| 80 | Norovirus Hu/GII.4/RotterdamP200/2005/NL | BAG68801 | 1897 | 6307 | 10717, 15127, 19537, 23947, 28357, 32767, 37177 |
| 81 | Norovirus Hu/GII.4/Stockholm/19865/2008/SE | BAH30707 | 1916 | 6326 | 10736, 15146, 19556, 23966, 28376, 32786, 37196 |
| 82 | Norovirus Hu/GII.6/OCO4062VLP/2004/JP | BAL40873 | 1921 | 6331 | 10741, 15151, 19561, 23971, 28381, 32791, 37201 |
| 83 | Norovirus Hu/GII.4/HS194/2009/US | ADB27914 | 1961 | 6371 | 10781, 15191, 19601, 24011, 28421, 32831, 37241 |
| 84 | Norovirus Hu/GII.12/HS210/2010/USA | ADT70684 | 1965 | 6375 | 10785, 15195, 19605, 24015, 28425, 32835, 37245 |
| 85 | Norovirus Hu/GI.1/8FIIa/1968/USA | AFJ38516 | 1970 | 6380 | 10790, 15200, 19610, 24020, 28430, 32840, 37250 |
| 86 | Norovirus Hu/GII.4/CHDC5191/1974/USA | AFJ38519 | 1971 | 6381 | 10791, 15201, 19611, 24021, 28431, 32841, 37251 |
| 87 | Norovirus Hu/GII.4/N76/2010/HuZhou | AFW15943 | 1975 | 6385 | 10795, 15205, 19615, 24025, 28435, 32845, 37255 |
| 88 | Norovirus Hu/GII.6/S9c/1976/SEN | AGE99599 | 2000 | 6410 | 10820, 15230, 19640, 24050, 28460, 32870, 37280 |
| 89 | Norovirus Hu/GII.4/KL45/1978/MYS | AGE99612 | 2001 | 6411 | 10821, 15231, 19641, 24051, 28461, 32871, 37281 |
| 90 | Norovirus Hu/GII.4/NIHIC17.5/2012/USA | AGT17839 | 2005 | 6415 | 10825, 15235, 19645, 24055, 28465, 32875, 37285 |
| 91 | Norovirus Hu/GII.4/NIHIC9/2011/USA | AFX71669 | 4198 | 8608 | 13018, 17428, 21838, 26248, 30658, 35068, 39478 |
| 92 | Norovirus Hu/GII.4/C110/1978/GUF | AGE99607 | 4336 | 8746 | 13156, 17566, 21976, 26386, 30796, 35206, 39616 |
| 93 | Norovirus Hu/GII.4/HS66/2001/USA | AHI59166 | 4379 | 8789 | 13199, 17609, 22019, 26429, 30839, 35249, 39659 |
| 94 | Norovirus Hu/GII/JP/2015/GII.P17_GII.17/Kawasaki308 | BAR42290 | 4395 | 8805 | 13215, 17625, 22035, 26445, 30855, 35265, 39675 |
| 95 | Norovirus Hu/GII/JP/2014/GII.P17_GII.17/Nagano8-1 | BAR63722 | 4399 | 8809 | 13219, 17629, 22039, 26449, 30859, 35269, 39679 |
| 96 | Norovirus Hu/GII/JP/2015/GII.Pe_GII.4/Osaka/OSF78 | BAS02084 | 4400 | 8810 | 13220, 17630, 22040, 26450, 30860, 35270, 39680 |
| 97 | Norovirus GI/Hu/NL/2011/GI.4/Groningan | CRL46953 | 4401 | 8811 | 13221, 17631, 22041, 26451, 30861, 35271, 39681 |
| 98 | Norovirus GII/Hu/NL/20l4/GII.4/Groningen01 | CRL46962 | 4404 | 8814 | 13224, 17634, 22044, 26454, 30864, 35274, 39684 |
| 99 | Norovirus Hu/GII.4/Kenepuru/NZ327/2006/NZL | ABQ63283 | 2018 | 6428 | 10838, 15248, 19658, 24068, 28478, 32888, 37298 |
| 100 | Norovirus Hu/GII.4/Rathmines/NSW287R/2007/AUS | ACW19927 | 2023 | 6433 | 10843, 15253, 19663, 24073, 28483, 32893, 37303 |

TABLE 3-continued

Selected VP1 Norovirus sequences (row 1-row 138)

| Row | column 1 Strain/Isolate | column 2 NCBI or Genbank Accession No. | column 3 A | column 4 B | column 5 C |
|---|---|---|---|---|---|
| 101 | Norovirus Hu/GII.4/Turramurra/NSW892U/2009/AUS | ADQ43783 | 2032 | 6442 | 10852, 15262, 19672, 24082, 28492, 32902, 37312 |
| 102 | Norovirus Hu/GII.4/Seoul/0389/2009/KOR | ADV37805 | 2033 | 6443 | 10853, 15263, 19673, 24083, 28493, 32903, 37313 |
| 103 | Norovirus Hu/GII.4/Seoul/0945/2009/KOR | ADV37919 | 2038 | 6448 | 10858, 15268, 19678, 24088, 28498, 32908, 37318 |
| 104 | Norovirus Hu/GII.12/Shelby/2009/USA | AEI83469 | 2039 | 6449 | 10859, 15269, 19679, 24089, 28499, 32909, 37319 |
| 105 | Norovirus Hu/GI.7/TCH-060/USA/2003 | AEQ77282 | 2041 | 6451 | 10861, 15271, 19681, 24091, 28501, 32911, 37321 |
| 106 | Norovirus Hu/GII.1/Ascension208/2010/USA | AFA55174 | 2042 | 6452 | 10862, 15272, 19682, 24092, 28502, 32912, 37322 |
| 107 | Norovirus Hu/GII.13/VA173/2010/USA | AFC89656 | 2043 | 6453 | 10863, 15273, 19683, 24093, 28503, 32913, 37323 |
| 108 | Norovirus Hu/GII.21/Salisbury150/2011/USA | AFC89665 | 2046 | 6456 | 10866, 15276, 19686, 24096, 28506, 32916, 37326 |
| 109 | Norovirus Hu/GII.4/1997/USA | AFJ04707 | 2049 | 6459 | 10869, 15279, 19689, 24099, 28509, 32919, 37329 |
| 110 | Norovirus Hu/GII.4/Farmington Hills/2004/USA | AFJ04708 | 2050 | 6460 | 10870, 15280, 19690, 24100, 28510, 32920, 37330 |
| 111 | Norovirus Hu/GII.4/Minerva/2006/USA | AFJ04709 | 2051 | 6461 | 10871, 15281, 19691, 24101, 28511, 32921, 37331 |
| 112 | Norovirus Hu/GII.4/Ohio/71/2012/USA | AFP89593 | 2052 | 6462 | 10872, 15282, 19692, 24102, 28512, 32922, 37332 |
| 113 | Norovirus Hu/GII.4/AlbertaE1065/2011/CA | AFU55731 | 2068 | 6478 | 10888, 15298, 19708, 24118, 28528, 32938, 37348 |
| 114 | Norovirus Hu/GII.4/SG4051-09/2009/SG | AFU92710 | 2119 | 6529 | 10939, 15349, 19759, 24169, 28579, 32989, 37399 |
| 115 | Norovirus Hu/GII.3/TCH-104/USA/2002 | AGO64038 | 2170 | 6580 | 10990, 15400, 19810, 24220, 28630, 33040, 37450 |
| 116 | Norovirus Hu/GI.6/TCH-099/USA/2003 | AGT62521 | 2174 | 6584 | 10994, 15404, 19814, 24224, 28634, 33044, 37454 |
| 117 | Norovirus 06-AM-I1/2006/GII.4/Yerseke/20006a | AJZ77004 | 2228 | 6638 | 11048, 15458. 19868, 24278, 28688, 33098, 37508 |
| 118 | Norovirus 09-BI-2/2009/GII.4/NewOrleans/2009 | AJZ77015 | 2231 | 6641 | 11051, 15461, 19871, 24281, 28691, 33101, 37511 |
| 119 | Norovirus Hu/GII.4/PR328/2013/ITA | AKE31861 | 2242 | 6652 | 11062, 15472, 19882, 24292, 28702, 33112, 37522 |
| 120 | Norovirus Hu/GII.P17__GII.17/PR668/2015/ITA | ALD09618 | 2253 | 6663 | 11073, 15483, 19893, 24303, 28713, 33123, 37533 |
| 121 | Norovirus Hu/GII.4/AlbertaSP1/2013/CA | ALT54494 | 2274 | 6684 | 11094, 15504, 19914, 24324, 28734, 33144, 37554 |
| 122 | Norovirus Hu/GII.4/C00007892/2011/UK | CCX28619 | 2280 | 6690 | 11100, 15510, 19920, 24330, 28740, 33150, 37560 |
| 123 | Norovirus Hu/GII.6/GZ2010-L96/Guangzhou/CHN/2011 | AGC96535 | 2330 | 6740 | 11150, 15560, 19970, 24380, 28790, 33200, 37610 |
| 124 | Norovirus Bo/GIII.1/Aba-Z5/2002/HUN | ABY67257 | 2341 | 6751 | 11161, 15571, 19981, 24391, 28801, 33211, 37621 |
| 125 | Norovirus GI.9 | AHA91656 | 2342 | 6752 | 11162, 15572, 19982, 24392, 28802, 33212, 37622 |
| 126 | Norovirus Hu/GII.17/CUHK-NS-670/HKG/2015 | KT315718 | 2488 | 6898 | 11308, 15718, 20128, 24538, 28948, 33358, 37768 |
| 127 | Norovirus GII/Hu/SI/2015/GII.17/Ljubljana1662 | KT591501 | 2509 | 6919 | 11329, 15739, 20149, 24559, 28969, 33379, 37789 |
| 128 | Norovirus Hu/GII.17/CUHK-NS-647/HKG/2015 | KT315706 | 2529 | 6939 | 11349, 15759, 20169, 24579, 28989, 33399, 37809 |
| 129 | Norovirus Hu/GII.21/CUHK-NS-609/HKG/2015 | KR921940 | 2540 | 6950 | 11360, 15770, 20180, 24590, 29000, 33410, 37820 |
| 130 | Norovirus Hu/GII.4/Melbourne6623/2016/AUS | KX767083 | 2600 | 7010 | 11420, 15830, 20240, 24650, 29060, 33470, 37880 |
| 131 | Norovirus GII/Hu/JP/2016/GII.P16__GII.4__Sydney2012/OH16002 | LC153121 | 2664 | 7074 | 11484, 15894, 20304, 24714, 29124, 33534, 37944 |
| 132 | Norovirus Hu/GII/JP/2016/GII.P16__GII.4__Sydney2012/Kawasaki194 | LC175468 | 3557 | 7966 | 12376, 16786, 21196, 25606, 30016, 34426, 38836 |
| 133 | Norovirus 16F2149__GII.2__Guangdong__CHN__2016 | KY485125 | 2438 | 6848 | 11258, 15668, 20078, 24488, 28898, 33308, 37718 |
| 134 | Norovirus Hu/GII.17/CUHK-NS-864/HKG/2016 | KU555841 | 2594 | 7004 | 11414, 15824, 20234, 24944, 29054, 33494, 37874 |
| 135 | Norovirus GII/Hu/ZAF/2012/GII.P4__GII.4/CapeTown/9772 | KP784696 | 2613 | 7023 | 11433, 15843, 20253, 24663, 29073, 33483, 37893 |
| 136 | Norovirus GII.12 | KP064099 | 4036 | 8446 | 12859, 17299, 21979, 29086, 30496, 34906, 39316 |

TABLE 3-continued

| Selected VP1 Norovirus sequences (row 1-row 138) | | | | | |
|---|---|---|---|---|---|
| Row | column 1 Strain/Isolate | column 2 NCBI or Genbank Accession No. | column 3 A | column 4 B | column 5 C |
| 137 | Snow Mountain virus | U70059 | 2441 | 6851 | 11261, 15671, 20081, 24491, 28901, 33311, 37721 |
| 138 | Human calicivirus strain Melksham | X81879 | 2359 | 6769 | 11179, 15589, 19999, 24409, 28819, 33229, 37639 |

Preferably, the molar ratio of the complexed nucleic acid to the free nucleic acid is selected from a molar ratio of about 0.001:1 to about 1:0.001, including a ratio of about 1:1. In a preferred embodiment, the invention provides a composition comprising at least one artificial nucleic acid as described herein, wherein the ratio of complexed nucleic acid to free nucleic acid is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is mast preferably about 1:1 (w/w).

In one embodiment, at least one artificial nucleic acid as defined herein or any other nucleic acid comprised in the inventive (pharmaceutical) composition or vaccine can also be associated with a vehicle, transfection or complexation agent for increasing the transfection efficiency and/or the immunostimulatory properties of the at least one artificial nucleic acid or of optionally comprised further included nucleic acids.

In the context of the present invention, a cationic or polycationic compound is preferably selected from any cationic or polycationic compound, suitable for complexing and thereby stabilizing a nucleic acid, particularly the at least one artificial nucleic acid of the inventive composition, e.g. by associating the at least one artificial nucleic acid with the cationic or polycationic compound. Such a cationic or polycationic compound per se does not need to exhibit any adjuvant properties, since an adjuvant property, particularly the capability of inducing an innate immune response, is preferably created upon complexing the at least one artificial nucleic acid with the cationic or polycationic compound. When complexing the at least one artificial nucleic acid with the cationic or polycationic compound, the adjuvant component is formed.

Particularly preferred, cationic or polycationic peptides or proteins (preferably also as component $P^2$ in a polymeric carrier according to formula IV herein) may be selected from protamine, nucleoline, spermine or spermidine, poly-L-lysine (PLL), basic polypeptides, poly-arginine, cell penetrating peptides (CPPs), chimeric CPPs, such as Transportan, or MPG peptides, HIV-binding peptides, Tat, HIV-1 Tat (HIV), Tat-derived peptides, oligoarginines, members of the penetratin family, e.g. Penetratin, Antennapedia-derived peptides (particularly from Drosophila antennapedia), pAntp, plsl, etc., antimicrobial-derived CPPs e.g. Buforin-2, Bac715-24, SynB, SynB(1), pVEC, ET-derived peptides, SAP, MAP, KALA, PpTG20, Proline-rich peptides, L-oligomers. Arginine-rich peptides, Calcitonin-peptides, FGF, Lactoferrin, poly-L-Lysine, poly-Arginine, histones, VP22 derived or analog peptides, HSV, VP22 (Herpes simplex), MAP, KALA or protein transduction domains (PTDs, PpT620, prolin-rich peptides, arginine-rich peptides, lysine-rich peptides, Pep-1, Calcitonin peptide(s), etc.

According to a preferred embodiment, cationic or polycationic proteins or peptides are selected from the following proteins or peptides having the following total formula (III):

$$(Arg)_l;(Lys)_m;(His)_n;(Orn)_o;(Xaa)_x, \qquad \text{formula (III)}$$

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3, 4, 5, 6, 7, or 8, provided, that the overall content of Xaa does not exceed 50% of all amino acids of the oligopeptide. Preferred cationic peptides in this context are e.g. $Arg_7$, $Arg_8$, $Arg_9$, $H_3R_9$, $R_9H_3$, $YSSR_9SSY$, $(RKH)_4$, $Y(RKH)_2R$, etc. In this context the disclosure of WO 2009/030481 is incorporated herewith by reference.

Further preferred cationic or polycationic compounds, which can be used for complexing the at least one artificial nucleic acid according to the invention may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPE, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc. Association or complexing the at least one artificial nucleic acid of the inventive composition with cationic or polycationic compounds preferably provides adjuvant properties to the at least one artificial nucleic acid and confers a stabilizing effect to the at least one artificial nucleic acid of the adjuvant component by complexation. The procedure for stabilizing the at least one artificial nucleic acid is in general described in EP-A-1083232, the disclosure of which is incorporated by reference into the present invention in its entirety. Particularly preferred as cationic or polycationic compounds are compounds selected from the group consisting of protamine, nucleoline, spermin, spermidine, oligoarginines as defined above, such as $Arg_7$, $Arg_8$, $Arg_9$, $Arg_7$, $H_3R_9$, $R_9H_3$, $H_3R_9H_3$, $YSSR_9SSY$, $(RKH)_4$, $Y(RKH)_2R$, etc.

According to a preferred embodiment, the inventive composition is formulated by using the at least one artificial nucleic acid according to the invention and one or more liposomes, lipoplexes, or lipid nanoparticles. In one embodiment, the inventive composition comprises liposomes. Liposomes are artificially-prepared vesicles, which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the inventive composition, in particular when applied as a pharmaceutical composition or a vaccine as described herein.

According to a preferred embodiment, the inventive composition comprises the artificial nucleic acid as described herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used in the composition according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable to complex the at least one artificial nucleic acid as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the at least one artificial nucleic acid or any further nucleic acid comprised in the inventive (pharmaceutical) composition or vaccine contains at least one —SH moiety, most preferably at least one cysteine residue or any further chemical group exhibiting an —SH moiety, capable to form a disulfide linkage upon condensation with at least one further cationic or polycationic protein, peptide or polymer as cationic component of the polymeric carrier as mentioned herein.

As defined above, the polymeric carrier, which may be used to complex the at least one artificial nucleic acid or any further nucleic acid comprised in the inventive (pharmaceutical) composition or vaccine may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined above for complexation agent.

In a further particular embodiment, the polymeric carrier which may be used to complex the at least one artificial nucleic acid or any further nucleic acid comprised in the inventive (pharmaceutical) composition or vaccine may be selected from a polymeric carrier molecule according to generic formula (IV):

$$L\text{-}P^1\text{—}S\text{-}[S\text{—}P^2\text{—}S]_n\text{—}S\text{—}P^3\text{-}L \qquad \text{formula (IV)}$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), $(AA)_x$, $[(AA)_x]_z$, or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa: or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20: or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) P' and/or $P^3$ or alternatively with further components (e.g. (AA), $(AA)_x$, or $[(AA)_x]_z$);

—S—S— is a (reversible) disulfide bond (the brackets are omitted for better readability), wherein S preferably represents sulphur or a —SH carrying moiety, which has formed a (reversible) disulfide bond. The (reversible) disulfide band is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]_z$, etc); The —SH-moiety may be part of the structure of these components or added by a modification as defined below;

L is an optional ligand, which may be present or not, and may be selected independent from the other from ROD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (IV) above (the brackets are omitted for better readability), wherein any of S, $P^1$ and $P^3$ are as defined herein, typically represent a situation, wherein one-SH-moiety of hydrophilic polymers $P^1$ and $P^3$ was condensed with one —SH-moiety of component $P^2$ of generic formula (IV) above, wherein both sulphurs of these —SH-moieties form a disulfide bond —S—S— as defined herein in formula (IV). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH— moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "-Cys-S" indicate a disulfide bond between a SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazine, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-methoxy-omega-mercapto polyethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one SH-moiety preferably at one terminal end, but may also contain two or even more SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

The complexed artificial nucleic acid in the inventive (pharmaceutical) composition or vaccine, is preferably prepared according to a first step by complexing the at least one artificial with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed artificial nucleic acid after complexing the artificial nucleic acid. Accordingly, the ratio of the at least one artificial nucleic acid and the cationic or polycationic compound and/or the polymeric carrier in the component of the complexed at least one artificial nucleic acid is typically selected in a range that the at least one artificial nucleic acid is entirely complexed and no free cationic or polycationic compound or polymeric carrier or only a negligibly small amount thereof remains in the composition.

The inventive composition comprising at least one artificial nucleic acid according to the invention may be provided in liquid and or in dry (e.g. lyophylized) form. In a preferred embodiment, the inventive artificial nucleic acid or the inventive composition is provided in lyophilized form. The inventive artificial nucleic acid and the inventive composition thus provide a possibility to store (irrespective of the ambient temperature and also without cooling) an artificial nucleic acid and a composition suitable for vaccination against Norovirus and related diseases or disorders. Preferably, the at least one lyophilized artificial nucleic acid is reconstituted in a suitable buffer, advantageously based on an aqueous carrier, e.g. Ringer-Lactate solution, prior to use, such as administration to a subject.

In one embodiment, the composition according to the invention a) comprises a plurality or more than one of the mRNA sequences as defined in the invention;

or b) comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids as defined in the invention, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids comprises at least one coding region encoding at least one polypeptide comprising a Norovirus protein as defined in the invention, and/or a fragment or a variant of any one of these proteins, wherein each coding region preferably encodes a different Norovirus protein, more preferably each coding region encodes a capsid protein, preferably VP1 of a different Norovirus.

In another embodiment, the composition according to the invention comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids of the invention, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more artificial nucleic acids comprises at least one coding region encoding at least one polypeptide comprising at least two different Norovirus proteins, preferably VP1 and VP2, as defined in the invention, and/or a fragment or a variant of any one of these proteins, and/or wherein each of the mRNA sequences encodes at least one different antigenic peptide or protein derived from proteins of the same Norovirus.

In a further embodiment, the composition according to the invention comprises mRNA sequences, wherein each of the mRNA sequences encodes at least one different antigenic peptide or protein derived from different proteins of the same Norovirus.

In a further embodiment, the composition according to the invention comprises mRNA sequences, wherein each of the mRNA sequences encodes at least one different antigenic peptide or protein derived from different proteins of different Noroviruses.

In a further aspect, the invention concerns a vaccine comprising the artificial nucleic acid as described herein or the inventive composition comprising at least one artificial nucleic acid according to the invention. Therein, the at least one artificial nucleic acid preferably elicits an adaptive immune response upon administration to a subject.

In a preferred embodiment, the inventive vaccine comprises the artificial nucleic acid as described herein or the inventive composition comprising at least one artificial nucleic acid according to the invention and a pharmaceutically acceptable carrier. Accordingly, the inventive vaccine is based on the same components as the inventive composition comprising at least one artificial nucleic acid according to the invention as defined above. Insofar, it may be referred to the above disclosure defining the inventive composition.

In one embodiment, the composition of the invention comprises a plurality or more than one of the mRNA sequences of the invention.

In one embodiment, the composition of the invention comprises a plurality or more than one of the mRNA sequences of the invention, wherein each of the mRNA sequences encodes at least one different antigenic peptide or protein derived from proteins of the same Norovirus.

In one embodiment, the composition of the invention comprises a plurality or more than one of the mRNA sequences of the invention, wherein each of the mRNA sequences encodes at least one different antigenic peptide or protein derived from different proteins of the same Norovirus.

In another embodiment, the composition of the invention comprises a plurality or more than one of the mRNA sequences of the invention, wherein each of the mRNA sequences encodes at least one different antigenic peptide or protein derived from different proteins of different Noroviruses.

In one embodiment, the vaccine of the invention is multivalent and comprises (i) at least 2, 3, 4, 5, 6, 7, 8, 9, 10 or more artificial nucleic acids of the invention; or (ii) at least 10, 15, 20 or 50 artificial nucleic acids of the invention; or (iii) 2-10, 10-15, 15-20, 20-50, 50-100 or 100-200 artificial nucleic acids of the invention.

In a further embodiment of the invention, the artificial nucleic acids of the vaccine of the invention (i) are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI Noroviruses; or (ii) are derived from a single GII Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, BE, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GII Noroviruses; or (iii) are derived from a single G111 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GIII Noroviruses; or (iv) are derived from a single GIV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GIV Noroviruses; or (v) are derived from a single GV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GV Noroviruses; or (vi) are derived from a single GI Norovirus and additionally from a single GII Norovirus, GIII Norovirus, GIV Norovirus and/or GV Norovirus: or (vii) are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76.77, 78, 79, 80, 81, 82, 83, 84, 85, 86, 87, 88, 89, 90, 91, 92, 93, 94, 95, 96, 97, 98, 99, 100 or more different GI Noroviruses and additionally from a single G11, G111, GIV and/or GV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more GII, GIII, GIV and/or GV Noroviruses.

In another embodiment of the invention, the artificial nucleic acids of the vaccine of the invention (i) are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, BO, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GI.1 Noroviruses: or (ii) are derived from a single 011.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different GII.4 Noroviruses; or (iii) are derived from a single GI.1 Norovirus and additionally from a single GII.4 Norovirus; or (iv) are derived from a single GI.1 Norovirus or from 2, 3, 4, 5, 5, 7, 8, 9, 10, 11, 12, 13, 14, 15, 16, 17, 18, 19, 20, 21, 22, 23, 24, 25, 25, 27, 28, 29, 30, 31, 32, 33, 34, 35, 36, 37, 38, 39, 40, 41, 42, 43, 44, 45, 45, 47, 48, 49, 50, 51, 52, 53, 54, 55, 55, 57, 58, 59, 60, 61, 62, 63, 64, 65, 66, 67, 68, 69, 70, 71, 72, 73, 74, 75, 75, 77, 78, 79, 80, 81, 82, 83, 84, 85, 86, 87, 88, 89, 90, 91, 92, 93, 94, 95, 95, 97, 98, 99, 100 or more different GI.1 Noroviruses and additionally from a single GII.4 Norovirus or from 2, 3, 4, 5, 5, 7, 8, 9, 10, 11, 12, 13, 14, 15, 16, 17, 18, 19, 20, 21, 22, 23, 24, 25, 25, 27, 28, 29, 30, 31, 32, 33, 34, 35, 35, 37, 38, 39, 40, 41, 42, 43, 44, 45, 45, 47, 48, 49, 50, 51, 52, 53, 54, 55, 56, 57, 58, 59, 60, 61, 62, 63, 64, 65, 66, 67, 68, 69, 70, 71, 72, 73, 74, 75, 75, 77, 78, 79, 80, 81, 82, 83, 84, 85, 85, 87, 88, 89, 90, 91, 92, 93, 94, 95, 95, 97, 98, 99, 100 or more GII.4 Noroviruses.

As with the composition according to the present invention, the entities of the vaccine may be provided in liquid and or in dry (e.g. lyophylized) form. They may contain further components, in particular further components allowing for its pharmaceutical use. The inventive vaccine or the inventive composition may, e.g., additionally contain a pharmaceutically acceptable carrier and/or further auxiliary substances and additives and/or adjuvants.

The inventive vaccine or composition typically comprises a safe and effective amount of the inventive artificial nucleic acid as defined herein. As used herein, "safe and effective amount" means an amount of the artificial nucleic acid of the composition or the vaccine as defined above, that is sufficient to significantly induce an immune response against a Norovirus protein. At the same time, however, a "safe and effective amount" is small enough to avoid serious side effects that is to say to permit a sensible relationship between advantage and risk. The determination of these limits typically lies within the scope of sensible medical judgment. In relation to the inventive vaccine or composition, the expression "safe and effective amount" preferably means an amount of the artificial nucleic acid that is suitable for stimulating the adaptive immune system in such a manner that no excessive or damaging immune reactions are achieved but, preferably, also no such immune reactions below a measurable level. Such a "safe and effective amount" of the artificial nucleic acid of the composition or vaccine as defined above may furthermore be selected in dependence of the type of artificial nucleic acid, e.g. monocistronic, bi- or even multicistronic mRNA, since a bi- or even multicistronic mRNA may lead to a significantly higher expression of the encoded polypeptide(s) than use of an equal amount of a monocistronic mRNA. A "safe and effective amount" of the artificial nucleic acid of the composition or vaccine as defined above may furthermore vary in connection with the particular objective of the treatment and also with the age and physical condition of the patient to be treated, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the artificial nucleic acid of the composition, vaccine or kit of parts according to the invention is provided in lyophilized form. Preferably, the lyophilized artificial nucleic acid is reconstituted in a suitable buffer, advantageously based on an aqueous carrier, prior to administration, e.g. Ringer-Lactate solution, which is preferred, Ringer solution, a phosphate buffer solution.

According to a preferred embodiment, the buffer suitable for injection may be used as a carrier in the inventive vaccine or composition or for resuspending the inventive vaccine or the inventive composition. Such a buffer suitable for injection may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

The choice of a pharmaceutically acceptable carrier is determined, in principle, by the manner, in which the inventive vaccine or the inventive composition is administered. The inventive vaccine or composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the inventive vaccine or the inventive composition may be administered by an intradermal, subcutaneous, or intramuscular route, preferably by injection, which may be needle-free and/or needle injection. Compositions/vaccines are therefore preferably formulated in liquid or solid form. The suitable amount of the inventive vaccine or composition to be administered can be determined by routine experiments with animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Adjuvants:

According to another embodiment, the inventive (pharmaceutical) composition or the inventive vaccine may comprise an adjuvant. An adjuvant may be used, for example, in order to enhance the immunostimulatory properties of the vaccine or composition. In this context, an adjuvant may be understood as any compound, which is suitable to support administration and delivery of the vaccine or composition according to the invention. Furthermore, such an adjuvant may, without being bound thereto, initiate or increase an immune response of the innate immune system, i.e. a non-specific immune response. In other words, when administered, the vaccine or composition according to the invention typically initiates an adaptive immune response due to the at least one polypeptide encoded by the artificial nucleic acid contained in the inventive vaccine or composition. Additionally, the vaccine or composition according to the invention may generate an (supportive) innate immune response due to addition of an adjuvant as defined herein to the vaccine or composition according to the invention.

In one embodiment, the adjuvant is selected from the group consisting of:

cationic or polycationic compounds, comprising cationic or polycationic peptides or proteins, including protamine, nucleoline, spermin or spermidine, poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpT620, proline-rich peptides, arginine-rich peptides, lysine-rich peptides, MPG-peptide(s), Pep-1, L-oligomers, Calcitonin peptide(s), Antennapedia-derived peptides (particularly from Drosophila antennapedia), pAntp, plsl, FGF, Lactoferrin, Transportan, Buforin-2, Bac715-24, SynB, SynB(1), pVEC, hCT-derived peptides, SAP, protamine, spermine, spermidine, or histones, cationic polysaccharides, including chitosan, polybrene, cationic polymers, including polyethyleneimine (PEI), cationic lipids, including DOTMA: [1-(2,3-sioleyloxy)propyl)]-N,N,N-trimethylammonium chloride, DMRIE, di-C14-amidine, DOTIM, SAINT, OC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonia)prapane, DC-6-14: D,D-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, including modified polyaminoacids, including β-aminoacid-polymers or reversed polyamides, modified polyethylenes, including PVP (poly(N-ethyl-4-vinylpyridinium bromide)), modified acrylates, including pDMAEMA (poly(dimethylaminoethyl methylacrylate)), modified Amidoamines including pAMAM (poly(amidoamine)), modified polybetaaminoester (PBAE), including diamine end modified 1,4 butanediol diacrylate-co-5-amino-1-pentanol polymers, dendrimers, including polypropylamine dendrimers or pAMAM based dendrimers, polyimine(s), including PEI: poly(ethyleneimine), poly(propyleneimine), polyallylamine, sugar backbone based polymers, including cyclodextrin based polymers, dextran based polymers, chitosan, etc., silan backbone based polymers, such as PMOXA-PDMS copolymers, etc., block polymers consisting of a combination of one or more cationic blocks selected from a cationic polymer as mentioned before, and of one or more hydrophilic- or hydrophobic blocks (e.g polyethyleneglycole);

or cationic or polycationic proteins or peptides, selected from the following proteins or peptides having the following total formula (III): (Arg)l; (Lys)m; (His)n; (Orn)o; (Xaa)x, wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except from Arg, Lys, His or Orn; and x may be any number selected from 0, 1, 2, 3 or 4, provided, that the overall content of Xaa does not exceed 50% of all amino acids of the oligopeptide; or nucleic acids having the formula (V): GlXmGn, wherein: G is guanosine, uracil or an analogue of guanosine or uracil; X is guanosine, uracil, adenosine, thymidine, cytosine or an analogue of the above-mentioned nucleotides; I is an integer from 1 to 40, wherein, when I=1 G is guanosine or an analogue thereof, when I>1 at least 50% of the nucleotides are guanosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 G is guanosine or an analogue thereof, when n>1 at least 50% of the nucleotides are guanosine or an analogue thereof;

or nucleic acids having the formula (VI): ClXmCn, wherein: C is cytosine, uracil or an analogue of cytosine or uracil; X is guanosine, uracil, adenosine, thymidine, cytosine or an analogue of the above-mentioned nucleotides; I is an integer from 1 to 40, wherein when I=1 C is cytosine or an analogue thereof, when I>1 at least 50% of the nucleotides are cytosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 Cis cytosine or an analogue thereof, when n>1 at least 50% of the nucleotides are cytosine or an analogue thereof;

or adjuvants selected from the group consisting of:

TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DOA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin: Gerbu adjuvant (mixture of: i) N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-O-isoglutamine); imiquimod (1-(2-methylpropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-(beta; interleukin-2; interleukin-7; interleukin-12; ISCOMS™; ISCOPREP 7.0.3.™; liposomes; LOXORIBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-0-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L112™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (Q5-21); Quil-A (Quil-A saponin); S-28403 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIDRAL; plant derived adjuvants, including Q521, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR1-10, ligands of murine TLR1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred are aluminium salts, such as aluminium phosphate ($AlPO_4$) or aluminium hydroxide ($Al(OH)_3$) and adjuvant compounds based thereon. More preferably, an aluminium salt, such as $AlPO_4$ (e.g. Adju-Phos) may be used in combination with the inventive artificial nucleic acid in its free form or with the inventive artificial nucleic acid complexed with a cationic or polycationic compound as described herein. Most preferably, an aluminium salt, such as $AlPO_4$ (e.g. Adju-Phos) may be used as adjuvant in combination with the inventive artificial nucleic acid in its free form.

Suitable adjuvants may also be selected from cationic or polycationic compounds, preferably as described herein, wherein the adjuvant is preferably prepared upon complexing the at least one artificial nucleic acid of the inventive composition or vaccine with the cationic or polycationic compound. Association or complexing the artificial nucleic acid with cationic or polycationic compounds as defined herein preferably provides adjuvant properties and confers a stabilizing effect to the artificial nucleic acid.

The ratio of the artificial nucleic acid to the cationic or polycationic compound in the adjuvant component may be calculated on the basis of the nitrogen/phosphate ratio (N/P-ratio) of the entire artificial nucleic acid complex, i.e. the ratio of positively charged (nitrogen) atoms of the cationic or polycationic compound to the negatively charged phosphate atoms of the nucleic acids. For example, 1 μg RNA typically contains about 3 nmol phosphate residues, provided the RNA exhibits a statistical distribution of bases. Additionally, 1 μg peptide typically contains about x nmol nitrogen residues, dependent on the molecular weight and the number of basic amino acids. When exemplarily calculated for (Arg)s (molecular weight 1424 g/mol, 9 nitrogen atoms), 1 μg (Arg)s contains about 700 pmol $(Arg)_9$ and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 μg RNA, 6 nmol phosphate are to be calculated for the RNA; 1 μg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of nucleic acid:peptide in the complex, and most preferably in the range of about 0.7-1.5.

In a preferred embodiment, the inventive vaccine or the inventive composition is obtained in two separate steps in order to obtain both, an efficient immunostimulatory effect and efficient translation of the artificial nucleic acid according to the invention. Therein, a so called "adjuvant component" is prepared by complexing—in a first step—a nucleic acid, preferably an RNA, of the adjuvant component with a cationic or polycationic compound in a specific ratio to form a stable complex. In this context, it is important, that no free cationic or polycationic compound or only a neglibly small amount remains in the adjuvant component after complexing the nucleic acid. Accordingly, the ratio of the nucleic acid, preferably an RNA, and the cationic or polycationic compound in the adjuvant component is typically selected in a range that the artificial nucleic acid is entirely complexed and no free cationic or polycationic compound or only a neglectably small amount remains in the composition. Preferably the ratio of the adjuvant component, i.e. the ratio of the artificial nucleic acid to the cationic or polycationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the artificial nucleic acid, preferably an mRNA, is added in a second step to the complexed nucleic acid, preferably an RNA, of the adjuvant component in order to form the (immunostimulatory) composition of the invention. Therein, the artificial nucleic acid is added as free nucleic acid, i.e. nucleic acid, which is not complexed by other compounds. Prior to addition, the free artificial nucleic acid is not complexed and will preferably not undergo any detectable or significant complexation reaction upon the addition of the adjuvant component. This is due to the strong binding of the cationic or polycationic compound to the above described artificial nucleic acid in the adjuvant component. In other words, when the artificial nucleic acid according to the invention, is added to the "adjuvant component", preferably no free or substantially no free cationic or polycationic compound is present, which may form a complex with the free artificial nucleic acid. Accordingly, an efficient translation of the free artificial nucleic acid of the inventive vaccine or composition is possible in vivo. Therein, the free artificial nucleic acid may occur, for example, as a mono-, di-, or multicistronic nucleic acid, i.e. an artificial nucleic acid which carries the coding sequences of one or more polypeptides. Such coding sequences in a di-, or even multicistronic nucleic acid may be separated by at least one IRES sequence, e.g. as defined herein.

In a particularly preferred embodiment, the free artificial nucleic acid, which is comprised in the inventive vaccine or composition, may be identical or different to the RNA of the adjuvant component of the inventive composition, depending on the specific requirements of therapy. Even more preferably, the artificial nucleic acid, preferably an mRNA, which is comprised in the inventive vaccine or composition, is identical to the RNA of the adjuvant component of the inventive vaccine or composition.

In a particularly preferred embodiment, the composition comprises the artificial nucleic acid, preferably an mRNA, wherein said artificial nucleic acid is present in the composition partially as free nucleic acid and partially as complexed nucleic acid. Preferably, the artificial nucleic acid, preferably an mRNA, is complexed as described above and the same artificial nucleic acid is then added as free nucleic acid, wherein preferably the compound, which is used for complexing the artificial nucleic acid is not present in free form in the composition at the moment of addition of the free nucleic acid component.

The ratio of the first component (i.e. the adjuvant component comprising or consisting of artificial nucleic acid complexed with a cationic or polycationic compound) and the second component (i.e. the free nucleic acid) may be selected in the inventive composition according to the specific requirements of a particular therapy. Typically, the ratio of the nucleic acid, preferably an RNA, in the adjuvant component and the at least one free artificial nucleic acid, preferably an mRNA, (artificial nucleic acid, preferably mRNA in the adjuvant component:free RNA) of the inventive composition is selected such that a significant stimulation of the innate immune system is elicited due to the adjuvant component. In parallel, the ratio is selected such that a significant amount of the at least one free artificial nucleic acid, preferably an mRNA, can be provided in vivo leading to an efficient translation and concentration of the expressed protein in vivo, e.g. the at least one encoded polypeptide as defined herein. Preferably, the ratio of the mRNA in the adjuvant component:free mRNA in the inventive composition is selected from a range of about 5:1 (w/w) to about 1:10 (w/w), more preferably from a range of about 4:1 (w/w) to about 1:8 (w/w), even more preferably from a range of about 3:1(w/w) to about 1:5 (w/w) or 1:3 (w/w), and most preferably the ratio of mRNA in the adjuvant component:free mRNA in the inventive composition is selected from a ratio of about 1:1 (w/w).

Additionally or alternatively, the ratio of the first component (i.e. the adjuvant component comprising or consisting of artificial nucleic acid complexed with a cationic or polycationic compound) and the second component (i.e. free artificial nucleic acid) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of artificial nucleic acid, preferably mRNA, complexed with a cationic or polycationic compound) and the second component (i.e. free artificial nucleic acid, preferably mRNA) may also be selected in the inventive composition on the basis of the molar ratio of both nucleic acids to each other, i.e. the nucleic acid of the adjuvant component, being complexed with a cationic or polycationic compound and the free nucleic acid of the second component. Typically, the molar ratio of the nucleic acid of the adjuvant component to the free nucleic acid of the second component may be selected such, that the molar ratio suffices the above (w/w) and/or N/P-definitions. More preferably, the molar ratio of the nucleic acid, preferably an mRNA, of the adjuvant component to the free nucleic acid, preferably an mRNA, of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the artificial nucleic acid, preferably an mRNA, of the adjuvant component to the free nucleic acid, preferably an mRNA, of the second component may be selected e.g. from a range of about 0.01:1 to 1:0.01. Most preferably, the molar ratio of the nucleic acid of the adjuvant component to the free nucleic acid of the second component may be selected e.g. from a molar ratio of about 1:1. Any of the above definitions with regard to (w/w) and/or N/P ratio may also apply.

Suitable adjuvants may furthermore be selected from nucleic acids having the formula (V): $G_lX_mG_n$, wherein: G is guanosine, uracil or an analogue of guanosine or uracil; X is guanosine, uracil, adenosine, thymidine, cytosine or an analogue of the above-mentioned nucleotides; I is an integer from 1 to 40, wherein when I=1 G is guanosine or an analogue thereof, when I>1 at least 50% of the nucleotides are guanosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 G is guanosine or an analogue thereof, when n>1 at least 50% of the nucleotides are guanosine or an analogue thereof.

Other suitable adjuvants may furthermore be selected from nucleic acids having the formula (VI): $C_lX_mC_n$, wherein: C is cytosine, uracil or an analogue of cytosine or uracil; X is guanosine, uracil, adenosine, thymidine, cytosine or an analogue of the above-mentioned nucleotides; I is an integer from 1 to 40, wherein when I=1 C is cytosine or an analogue thereof, when I>1 at least 50% of the nucleotides are cytosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 C is cytosine or an analogue thereof, when n>1 at least 50% of the nucleotides are cytosine or an analogue thereof.

The inventive vaccine or composition can additionally contain one or more auxiliary substances in order to further increase the immunogenicity. A synergistic action of the artificial nucleic acid of the composition or vaccine as defined herein and of an auxiliary substance, which may be optionally be co-formulated (or separately formulated) with the inventive vaccine or composition as described above, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a “danger signal” (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)).

According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the B (guanine) of the CpG motif can also be present in methylated form.

Preferably, the above compounds are formulated and administered separately from the above composition or vaccine (of the invention) containing the artificial nucleic acid according to the invention.

Polypeptide:

In a further aspect, the present invention concerns a polypeptide encoded by the inventive artificial nucleic acid as described herein, or a fragment of said polypeptide.

More preferably, the inventive polypeptide comprises or consists of, preferably in this order from N-terminus to C-terminus:

a) an amino acid sequence derived from a C-terminal fragment from mature Norovirus capsid protein VP1, or a variant thereof, wherein the C-terminal fragment preferably comprises or consists of 3 to 20 amino acid residues, b) an amino acid sequence derived from a signal sequence of Norovirus capsid protein VP1, or a fragment or variant thereof, or an amino acid sequence derived from a C-terminal fragment, or a variant thereof, of Norovirus capsid protein VP1 as present in Norovirus polyprotein before cleavage, preferably as described herein.

More preferably, the inventive polypeptide is selected from the group consisting of Norovirus NS1/NS2, NS3, NS4, NS5, NS6, NS7, VP1, and VP2, or a fragment or variant of any of these proteins, and at least one amino acid sequence selected from the group consisting of:

a) an amino acid sequence derived from a C-terminal fragment from mature Norovirus capsid protein VP1, or a variant thereof, wherein the C-terminal fragment consists of 3 to 20 amino acid residues, b) an amino acid sequence derived from a signal sequence of Norovirus capsid protein VP1, or a fragment or variant thereof, and c) an amino acid sequence derived from an N-terminal fragment from mature Norovirus non-structural protein NS1/NS2, NS3, NS4, NS5, NS6, or NS7, or a variant thereof, wherein the N-terminal fragment consists of 3 to 20 amino acid residues.

In a preferred embodiment, the inventive polypeptide does not comprise an amino acid sequence from Norovirus capsid protein VP1 or from Norovirus non-structural protein 1 (NS1) distinct from the following amino acid sequences:

a) an amino acid sequence derived from a C-terminal fragment from mature Norovirus capsid protein VP1, or a variant thereof, wherein the C-terminal fragment preferably comprises or consists of 3 to 20 amino acid residues, b) an amino acid sequence derived from a signal sequence of Norovirus capsid protein VP1, or a fragment or variant thereof, or an amino acid sequence derived from a C-terminal fragment, or a variant thereof, of Norovirus capsid protein VP1 as present in Norovirus polyprotein before cleavage, preferably as described herein, and c) an amino acid sequence derived from an N-terminal fragment from mature Norovirus non-structural protein (NS1), or a variant thereof, wherein the N-terminal fragment preferably comprises or consists of 3 to 20 amino acid residues.

According to a preferred embodiment, the inventive polypeptides as described herein comprises a molecular tag, wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

In a further aspect, the present invention provides a composition comprising at least one of the inventive polypeptides as described herein. In a preferred embodiment, the inventive composition comprises one type of polypeptide as described herein. Alternatively, the inventive composition may comprise at least two different inventive polypeptides as described herein.

Preferably, the inventive composition comprises or consists of at least one of the inventive polypeptides described herein and a pharmaceutically acceptable carrier. In this context, the pharmaceutically acceptable carrier as well as optional further components of the composition are preferably as described herein with respect to the inventive composition comprising at least one inventive artificial nucleic acid.

In a further aspect, the invention concerns a vaccine comprising the inventive composition comprising at least one of the polypeptides according to the invention. Therein, the at least one of the inventive polypeptides preferably elicits an adaptive immune response upon administration to a subject. More preferably, the vaccine according to the invention comprising at least one of the inventive polypeptides or the inventive composition comprising at least one of the polypeptides according to the invention is preferably a vaccine as described herein. Reference is made to the respective description herein.

As used herein, the term 'inventive composition' may refer to the inventive composition comprising at least one artificial nucleic acid according to the invention as well as to the inventive composition comprising at least one of the polypeptides according to the invention. Likewise, the term 'inventive vaccine', as used in this context, may refer to an inventive vaccine, which is based on the inventive artificial nucleic acid, i.e. which comprises at least one artificial nucleic acid according to the invention or which comprises the inventive composition comprising said artificial nucleic acid, as well as to an inventive vaccine, which is based on the inventive polypeptide(s), i.e. which comprises at least one polypeptide according to the invention or which comprises the inventive composition comprising said at least one polypeptide according to the invention.

According to another embodiment, the present invention also provides kits, particularly kits of parts, comprising the artificial nucleic acid according to the invention, the inventive composition comprising at least one artificial nucleic acid according to the invention, the inventive polypeptides as described herein, the inventive composition comprising at least one inventive polypeptide or the inventive vaccine as described herein, optionally a liquid vehicle for solubilising and optionally technical instructions with information on the administration and dosage of the artificial nucleic acid according as described herein, the inventive composition comprising at least one artificial nucleic acid according to the invention, the inventive polypeptides as described herein, the inventive composition comprising at least one inventive polypeptide or the inventive vaccine. The technical instructions may contain information about administration and dosage. Such kits, preferably kits of parts, may be applied e.g. for any of the applications or uses mentioned herein, preferably for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of a Norovirus infection or diseases or disorders related thereto. The kits may also be applied for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of Norovirus infection or diseases or disorders related thereto, wherein the artificial nucleic acid according as described herein, the inventive composition comprising at least one artificial nucleic acid according to the invention, the inventive polypeptides as described herein, the inventive composition comprising at least one inventive polypeptide or the inventive vaccine may induce or enhance an immune response in a mammal as defined above. Preferably, the artificial nucleic acid according as described herein, the inventive composition comprising at least one artificial nucleic acid according to the invention, or the inventive vaccine is provided in a separate part of the kit, wherein the artificial nucleic acid according as described herein, the inventive composition comprising at least one artificial nucleic acid according to the invention, or the inventive vaccine are preferably lyophilised. More preferably, the kit further contains as a part a vehicle for solubilising the artificial nucleic acid according as described herein, the inventive composition comprising at least one artificial nucleic acid according to the invention, or the inventive vaccine, the vehicle preferably being Ringer-lactate solution. Any of the above kits may be used in a treatment or prophylaxis as defined above. More preferably, any of the above kits may be used as a vaccine, preferably a vaccine against Norovirus infection or a related disease or disorder.

The present invention furthermore provides several applications and uses of the artificial nucleic acid according to the invention, the inventive composition comprising at least one artificial nucleic acid according to the invention, the inventive polypeptides as described herein, the inventive composition comprising at least one inventive polypeptide or the inventive vaccine or of kits comprising same. In particular, the inventive (pharmaceutical) composition(s) or the inventive vaccine may be used for human and also for veterinary medical purposes, preferably for human medical purposes, as a pharmaceutical composition in general or as a vaccine.

In a further aspect, the invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for use in a method of prophylactic (pre-exposure prophylaxis or post-exposure prophylaxis) and/or therapeutic treatment of Norovirus infections. Consequently, in a further aspect, the present invention is directed to the first medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts as defined herein as a medicament. Particularly, the invention provides the use of an artificial nucleic acid comprising at least one coding region encoding at least one polypeptide comprising at least one Norovirus protein as defined herein, or a fragment or variant thereof as described herein for the preparation of a medicament.

According to another aspect, the present invention is directed to the second medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for the treatment of an infection with Norovirus or a disease or disorder related to an infection with Norovirus as defined herein. Particularly, the artificial nucleic acid comprising at least one coding region encoding at least one polypeptide comprising at least one Norovirus protein as defined herein, or a fragment or variant thereof as described herein to be used in a method as said above is an artificial nucleic acid formulated together with a pharmaceutically acceptable vehicle and an optionally additional adjuvant and an optionally additional further component as defined herein.

The invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for medical use, in particular for the treatment of an infection with Norovirus or a disease or disorder related to an infection with Norovirus, wherein preferably an infection with Norovirus may involve any Norovirus strain. More preferably, the Norovirus infection is caused by a Norovirus strain, which is selected from the group consisting of GII.4 CIN-1 Norovirus or a GII.4 Sydney Norovirus, GI.1 and GII.4 Sydney 2012 Norovirus. Further preferably, the Norovirus infection is caused by a Norovirus strain GII.4 Sydney or GII.4 Sydney 2012.

As used herein, "a disorder related to a Norovirus infection" or "a disease related to a Norovirus infection" may preferably comprise a complication of Norovirus infection, such as abdominal pain, diarrhea, DIC (disseminated intravascular coagulation), fever, fever/chills, gastrointestinal symptoms, headache, nausea, neck stiffness, obtundation, photophobia, and/or vomiting. In a preferred embodiment, the inventive composition or vaccine is thus used for treatment or prophylaxis, preferably prophylaxis, of complications associated with a Norovirus infection.

The inventive composition or the inventive vaccine, in particular the inventive composition comprising at least one artificial nucleic acid according to the invention, the inventive polypeptides as described herein or the inventive composition comprising at least one inventive polypeptide, can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, vaccines may be administered by an intradermal, subcutaneous, or intramuscular route. Inventive vaccines are therefore preferably formulated in liquid (or sometimes in solid) form. Preferably, the inventive vaccine may be administered by conventional needle injection or needle-free jet injection. In a preferred embodiment the inventive vaccine or composition may be administered by jet injection as defined herein, preferably intramuscularly or intradermally, more preferably intradermally.

In a preferred embodiment, a single dose of the inventive artificial nucleic acid, composition or vaccine comprises a specific amount of the artificial nucleic acid according to the invention. Preferably, the inventive artificial nucleic acid is provided in an amount of at least 10 μg per dose, 40 μg per dose, preferably in an amount of from 40 to 700 μg per dose, more preferably in an amount of from BD to 400 μg per dose. More specifically, in the case of intradermal injection, which is preferably carried out by using a conventional needle, the amount of the inventive artificial nucleic acid comprised in a single dose is typically at least 200 μg, preferably from 200 μg to 1.000 μg, more preferably from 300 μg to 850 μg, even more preferably from 300 μg to 700 μg. In the case of intradermal injection, which is preferably carried out via jet injection (e.g. using a Tropis device), the amount of the inventive artificial nucleic acid comprised in a single dose is typically at least 80 μg, preferably from 80 μg to 700 μg, more preferably from 80 μg to 400 μg. Moreover, in the case of intramuscular injection, which is preferably carried out by using a conventional needle or via jet injection, the amount of the inventive artificial nucleic acid comprised in a single dose is typically at least 80 μg, preferably from 80 μg to 1000 μg, more preferably from BO μg to 850 μg, even more preferably from 80 μg to 700 μg.

Depending on the used formulation, the used route of application, and depending on the subject (human, animal), the dose of the inventive artificial nucleic acid may range from about 1 μg to about 1000 μg, preferably from about 10 μg to about 500 μg.

The immunization protocol for the treatment or prophylaxis of a Norovirus infection, i.e the immunization of a subject against Norovirus, typically comprises a series of single doses or dosages of the inventive composition or the inventive vaccine. A single dosage, as used herein, refers to the initial/first dose, a second dose or any further doses, respectively, which are preferably administered in order to "boost" the immune reaction.

According to a preferred embodiment, the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts is provided for use in treatment or prophylaxis, preferably treatment or prophylaxis of a Norovirus infection or a related disorder or disease, wherein the treatment or prophylaxis comprises the administration of a further active pharmaceutical ingredient. More preferably, in the case of the inventive vaccine or composition, which is based on the inventive artificial nucleic acid, a polypeptide may be co-administered as a further active pharmaceutical ingredient. For example, at least one Norovirus protein as described herein, or a fragment or variant thereof, may be co-administered in order to induce or enhance an immune response. Likewise, in the case of the inventive vaccine or composition, which is based on the inventive polypeptide as described herein, an artificial nucleic acid as described herein may be co-administered as a further active pharmaceutical ingredient. For example, an artificial nucleic acid as described herein encoding at least one polypeptide as described herein may be co-administered in order to induce or enhance an immune response.

A further component of the inventive vaccine or composition may be an immunotherapeutic agent that can be selected from immunoglobulins, preferably IgGs, monoclonal or polyclonal antibodies, polyclonal serum or sera, etc, most preferably immunoglobulins directed against a Norovirus. Preferably, such a further immunotherapeutic agent may be provided as a peptide/protein or may be encoded by a nucleic acid, preferably by a DNA or an RNA, more preferably an mRNA. Such an immunotherapeutic agent allows providing passive vaccination additional to active vaccination triggered by the inventive artificial nucleic acid or by the inventive polypeptide.

In a further aspect the invention provides a method of treating or preventing a disorder, wherein the disorder is preferably an infection with Norovirus or a disorder related to an infection with Norovirus, wherein the method comprises administering to a subject in need thereof the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts.

In particular, such a method may preferably comprise the steps of:

a) providing the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts;

b) applying or administering the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts to a tissue or an organism;

c) optionally administering immune globuline against Norovirus.

According to a further aspect, the present invention also provides a method for expression of at least one polypeptide comprising at least one Norovirus, or a fragment or variant thereof, wherein the method preferably comprises the following steps:

a) providing the inventive artificial nucleic acid comprising at least one coding region encoding at least one polypeptide comprising at least one Norovirus, or a fragment or variant thereof, preferably as defined herein, or a composition comprising said artificial nucleic acid: and b) applying or administering the inventive artificial nucleic acid or the inventive composition comprising said artificial nucleic acid to an expression system, e.g. to a cell-free expression system, a cell (e.g. an expression host cell or a somatic cell), a tissue or an organism.

The method may be applied for laboratory, for research, for diagnostic, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, e.g. in naked or complexed form or as a (pharmaceutical) composition or vaccine as described herein, preferably via transfection or by using any of the administration modes as described herein. The method may be carried out in vitro, in viva or ex viva. The method may furthermore be carried out in the context of the treatment of a specific disease, particularly in the treatment of infectious diseases, preferably Norovirus infection or a related disorder as defined herein.

In this context, in vitro is defined herein as transfection or transduction of the inventive artificial nucleic acid as defined herein or of the inventive composition or vaccine as defined herein into cells in culture outside of an organism; in viva is defined herein as transfection or transduction of the inventive artificial nucleic acid or of the inventive composition or vaccine into cells by application of the inventive mRNA or of the inventive composition to the whole organism or individual and ex vivo is defined herein as transfection or transduction of the inventive artificial nucleic acid or of the inventive composition or vaccine into cells outside of an organism or individual and subsequent application of the transfected cells to the organism or individual.

Likewise, according to another aspect, the present invention also provides the use of the inventive artificial nucleic acid as defined herein or of the inventive composition or vaccine as defined herein, preferably for diagnostic or therapeutic purposes, for expression of an encoded antigenic peptide or protein, e.g. by applying or administering the inventive artificial nucleic acid as defined herein or of the inventive composition or vaccine as defined herein, e.g. to a cell-free expression system, a cell (e.g. an expression host cell or a somatic cell), a tissue or an organism. The use may be applied for a (diagnostic) laboratory, for research, for diagnostics, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, preferably in naked form or complexed form, or as a (pharmaceutical) composition or vaccine as described herein, preferably via transfection or by using any of the administration modes as described herein. The use may be carried out in vitro, in vivo or ex vivo. The use may furthermore be carried out in the context of the treatment of a specific disease, particularly in the treatment of Norovirus infection or a related disorder.

In a particularly preferred embodiment, the invention provides the artificial nucleic acid, the inventive composition or the inventive vaccine for use as defined herein, preferably for use as a medicament, for use in treatment or prophylaxis, preferably treatment or prophylaxis of a Norovirus infection or a related disorder, or for use as a vaccine. The vaccine or composition according to the invention can be used according to the invention for human and also for veterinary medical purposes (mammals, vertebrates), as a pharmaceutical composition or as a vaccine.

Adjuvants:

According to another embodiment, the (pharmaceutical) composition or vaccine according to the invention may comprise an adjuvant, which is preferably added in order to enhance the immunostimulatory properties of the composition. In this context, an adjuvant may be understood as any compound, which is suitable to support administration and delivery of the composition according to the invention. Furthermore, such an adjuvant may, without being bound thereto, initiate or increase an immune response of the innate immune system, i.e. a non-specific immune response. In other words, when administered, the composition according to the invention typically initiates an adaptive immune response due to an antigen as defined herein or a fragment or variant thereof, which is encoded by the at least one coding sequence of the inventive mRNA contained in the composition of the present invention. Additionally, the composition according to the invention may generate an (supportive) innate immune response due to addition of an adjuvant as defined herein to the composition according to the invention.

Particularly preferred, an adjuvant may be selected from adjuvants, which support induction of a Th1-immune response or maturation of naïve T-cells, such as GM-CSF, IL-12, IFN0, any immunostimulatory nucleic acid as defined above, preferably an immunostimulatory RNA, CpG DNA, etc.

In a further preferred embodiment it is also possible that the inventive composition contains besides the antigen-providing mRNA further components which are selected from the group comprising: further antigens (e.g. in the form of a peptide or protein) or further antigen-encoding nucleic acids; a further immunotherapeutic agent; one or more auxiliary substances; or any further compound, which is known to be immunostimulating due to its binding affinity (as ligands) to human Toll-like receptors; and/or an adjuvant nucleic acid, preferably an immunostimulatory RNA (isRNA).

The composition of the present invention can additionally contain one or more auxiliary substances in order to increase its immunogenicity or immunostimulatory capacity, if desired. A synergistic action of the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH.

Suitable adjuvants may also be selected from cationic or polycationic compounds wherein the adjuvant is preferably prepared upon complexing the mRNA of the composition according to the invention with the cationic or polycationic compound. Associating or complexing the mRNA of the composition with cationic or polycationic compounds as defined herein preferably provides adjuvant properties and confers a stabilizing effect to the mRNA of the composition. In particular, such preferred cationic or polycationic compounds are selected from cationic or polycationic peptides or proteins, including protamine, nucleoline, spermin or spermidine, or other cationic peptides or proteins, such as poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpTG20, prolin-rich peptides, arginine-rich peptides, lysine-rich peptides, MPG-peptide(s), Pep-1, L-oligomers, Calcitonin peptide(s), Antennapedia-derived peptides (particularly from Drosophila antennapedia), pAntp, plsl, FGF, Lactoferrin, Transportan, Buforin-2, Bac715-24, SynB, SynB(1), pVEC, hCT-derived peptides, SAP, protamine, spermine, spermidine, or histones. Further preferred cationic or polycationic compounds may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected of a cationic polymer as mentioned above) and of one or more hydrophilic- or hydrophobic blocks (e.g polyethyleneglycole); etc.

Additionally, preferred cationic or polycationic proteins or peptides, which can be used as an adjuvant by complexing the mRNA of the composition according to the invention, may be selected from following proteins or peptides having the following total formula (III): (Arg)l; (Lys)m; (His)n; (Orn)o; (Xaa)x, wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred oligoarginines in this context are e.g. Arg7, Arg8, Arg9, Arg7, H3R9, R9H3, H3R9H3, YSSR9SSY, (RKH)4, Y(RKH)2R, etc.

The ratio of the mRNA to the cationic or polycationic compound in the adjuvant component may be calculated on the basis of the nitrogen/phosphate ratio (N/P-ratio) of the entire mRNA complex, i.e. the ratio of positively charged (nitrogen) atoms of the cationic or polycationic compound to the negatively charged phosphate atoms of the nucleic acids. For example, 1 μg of RNA typically contains about 3 nmol phosphate residues, provided the RNA exhibits a statistical distribution of bases. Additionally, 1 μg of peptide typically contains about x nmol nitrogen residues, dependent on the molecular weight and the number of basic amino acids. When exemplarily calculated for (Arg)9 (molecular weight 1424 g/mol, 9 nitrogen atoms), 1 μg (Arg)9 contains about 700 pmol (Arg)9 and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 Ξg RNA, 6 nmol phosphate are to be calculated for the RNA: 1 μg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

In a preferred embodiment, the composition of the present invention is obtained in two separate steps in order to obtain both, an efficient immunostimulatory effect and efficient translation of the mRNA according to the invention. Therein, a so called "adjuvant component" is prepared by complexing in a first step an mRNA as defined herein of the adjuvant component with a cationic or polycationic compound in a specific ratio to form a stable complex. In this context, it is important, that no free cationic or polycationic compound or only a negligibly small amount remains in the adjuvant component after complexing the mRNA. Accordingly, the ratio of the mRNA and the cationic or polycationic compound in the adjuvant component is typically selected in a range that the mRNA is entirely complexed and no free cationic or polycationic compound or only a negligible small amount remains in the composition. Preferably the ratio of the adjuvant component, i.e. the ratio of the mRNA to the cationic or polycationic compound is selected from a range of about 9:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the mRNA of the invention comprising at least one mRNA sequence comprising at least one coding region as defined herein is added in a second step to the complexed mRNA of the adjuvant component in order to form the (immunostimulatory) composition of the invention. Therein, the mRNA of the composition according to the invention is added as free mRNA, which is not complexed by other compounds. Prior to addition, the free mRNA is not complexed and will preferably not undergo any detectable or significant complexation reaction upon the addition of the adjuvant component. This is due to the strong binding of the cationic or polycationic compound to the above described mRNA according to the invention comprised in the adjuvant component. In other words, when the mRNA comprising at least one coding region as defined herein is added to the "adjuvant component", preferably no free or substantially no free cationic or polycationic compound is present, which could form a complex with the free mRNA. Accordingly, an efficient translation of the mRNA of the composition is possible in vivo. Therein, the free mRNA, may occur as a mono-, di-, or multicistronic mRNA, i.e. an mRNA which carries the coding sequences of one or more proteins. Such coding sequences in di-, or even multicistronic mRNA may be separated by at least one IRES sequence, e.g. as defined herein.

In a particularly preferred embodiment, the free mRNA as defined herein, which is comprised in the composition of the present invention, may be identical or different to the RNA as defined herein, which is comprised in the adjuvant component of the composition, depending on the specific requirements of therapy. Even more preferably, the free RNA, which is comprised in the composition according to the invention, is identical to the RNA of the adjuvant component of the inventive composition.

In a particularly preferred embodiment, the composition according to the invention comprises the mRNA of the invention, which encodes at least one antigenic peptide or protein as defined herein and wherein said mRNA is present in the composition partially as free mRNA and partially as complexed mRNA. Preferably, the mRNA as defined herein is complexed as described above and the same mRNA is then added as free mRNA, wherein preferably the compound, which is used for complexing the mRNA is not present in free form in the composition at the moment of addition of the free mRNA component.

The ratio of the first component (i.e. the adjuvant component comprising or consisting of the mRNA as defined herein complexed with a cationic or polycationic compound) and the second component (i.e. the free mRNA as defined herein) may be selected in the inventive composition according to the specific requirements of a particular therapy. Typically, the ratio of the mRNA in the adjuvant component and the at least one free mRNA (mRNA in the adjuvant component:free mRNA) of the composition according to the invention is selected such that a significant stimulation of the innate immune system is elicited due to the adjuvant component. In parallel, the ratio is selected such that a significant amount of the free mRNA can be provided in vivo leading to an efficient translation and concentration of the expressed protein in vivo, e.g. the at least one antigenic peptide or protein as defined herein. Preferably the ratio of the mRNA in the adjuvant component:free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component: free mRNA in the inventive composition is selected from a ratio of about 1:1 (w/w).

Additionally or alternatively, the ratio of the first component (i.e. the adjuvant component comprising or consisting of the mRNA complexed with a cationic or polycationic compound) and the second component (i.e. the free mRNA) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of the mRNA complexed with a cationic or polycationic compound) and the second component (i.e. the free mRNA) may also be selected in the composition according to the invention on the basis of the molar ratio of both mRNAs to each other, i.e. the mRNA of the adjuvant component, being complexed with a cationic or polycationic compound and the free mRNA of the second component. Typically, the molar ratio of the mRNA of the adjuvant component to the free mRNA of the second component may be selected such, that the molar ratio suffices the above (w/w) and/or N/P-definitions. More preferably, the molar ratio of the mRNA of the adjuvant component to the free mRNA of the second component may be selected e.g. from a molar ratio of about 0.001:1, 0.01:1, 0.1:1, 0.2:1, 0.3:1, 0.4:1, 0.5:1, 116:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the mRNA of the adjuvant component to the free mRNA of the second component may be selected e.g. from a range of about 0.01:1 to 1:0.01. Most preferably, the molar ratio of the mRNA of the adjuvant component to the free mRNA of the second component may be selected e.g. from a molar ratio of about 1:1. Any of the above definitions with regard to (w/w) and/or N/P ratio may also apply.

Suitable adjuvants may furthermore be selected from nucleic acids having the formula (Va): GIXmGn, wherein: G is guanosine, uracil or an analogue of guanosine or uracil; X is guanosine, uracil, adenosine, thymidine, cytosine or an analogue of the above-mentioned nucleotides; I is an integer from 1 to 40, wherein when I=1 G is guanosine or an analogue thereof, when I>1 at least 50% of the nucleotides are guanosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 G is guanosine or an analogue thereof, when n>1 at least 50% of the nucleotides are guanosine or an analogue thereof, or formula (Vb): (NuGIXmGnNv)a, wherein: G is guanosine (guanine), uridine (uracil) or an analogue of guanosine (guanine) or uridine (uracil), preferably guanosine (guanine) or an analogue thereof; X is guanosine (guanine), uridine (uracil), adenosine (adenine), thymidine (thymine), cytidine (cytosine), or an analogue of these nucleotides (nucleosides), preferably uridine (uracil) or an analogue thereof; N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides); a is an integer from 1 to 20, preferably from 1 to 15, most preferably from 1 to 10; I is an integer from 1 to 40, wherein when I=1 G is guanosine (guanine) or an analogue thereof, when I>1, at least 50% of these nucleotides (nucleosides) are guanosine (guanine) or an analogue thereof; m is an integer and is at least 3; wherein when m=3. X is uridine (uracil) or an analogue thereof, and when m>3, at least 3 successive uridines (uracils) or analogues of uridine (uracil) occur; n is an integer from 1 to 40, wherein when n=1, G is guanosine (guanine) or an analogue thereof, when n>1, at least 50% of these nucleotides (nucleosides) are guanosine (guanine) or an analogue thereof; u,v may be independently from each other an integer from 0 to 50, preferably wherein when u=0, v≥1, or when v=0, u≥1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI): CIXmCn, wherein: C is cytosine, uracil or an analogue of cytosine or uracil; X is guanosine, uracil, adenosine, thymidine, cytosine or an analogue of the above-mentioned nucleotides; I is an integer from 1 to 40, wherein when I=1 C is cytosine or an analogue thereof, when I>1 at least 50% of the nucleotides are cytosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 C is cytosine or an analogue thereof, when n>1 at least 50% of the nucleotides are cytosine or an analogue thereof.

In this context the disclosure of WO 2003/014979 and WO 2009/095229 is also incorporated herein by reference.

In a further aspect, the present invention provides a vaccine, which is based on the mRNA sequence according to the invention comprising at least one coding region as defined herein. The vaccine according to the invention is preferably a (pharmaceutical) composition as defined herein.

Accordingly, the vaccine according to the invention is based on the same components as the (pharmaceutical) composition described herein. Insofar, it may be referred to the description of the (pharmaceutical) composition as provided herein. Preferably, the vaccine according to the invention comprises at least one mRNA comprising at least one mRNA sequence as defined herein and a pharmaceutically acceptable carrier. In embodiments, where the vaccine comprises more than one mRNA sequence (such as a plurality of RNA sequences according to the invention, wherein each preferably encodes a distinct antigenic peptide or protein), the vaccine may be provided in physically separate form and may be administered by separate administration steps. The vaccine according to the invention may correspond to the (pharmaceutical) composition as described herein, especially where the mRNA sequences are provided by one single composition. However, the inventive vaccine may also be provided physically separated. For instance, in embodiments, wherein the vaccine comprises more than one mRNA sequences/species, these RNA species may be provided such that, for example, two, three, four, five or six separate compositions, which may contain at least one mRNA species/sequence each (e.g. three distinct mRNA species/sequences), each encoding distinct antigenic peptides or proteins, are provided, which may or may not be combined. Also, the inventive vaccine may be a combination of at least two distinct compositions, each composition comprising at least one mRNA encoding at least one of the antigenic peptides or proteins defined herein. Alternatively, the vaccine may be provided as a combination of at least one mRNA, preferably at least two, three, four, five, six or more mRNAs, each encoding one of the antigenic peptides or proteins defined herein. The vaccine may be combined to provide one single composition prior to its use or it may be used such that more than one administration is required to administer the distinct mRNA sequences/species encoding any of the antigenic peptides or proteins as defined herein. If the vaccine contains at least one mRNA sequence, typically at least two mRNA sequences, encoding the antigen combinations defined herein, it may e.g. be administered by one single administration (combining all mRNA species/sequences), by at least two separate administrations. Accordingly; any combination of mono-, bi- or multicistronic mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention. According to a particularly preferred embodiment of the inventive vaccine, the at least one antigen, preferably a combination as defined herein of at least two, three, four, five, six or more antigens encoded by the inventive composition as a whole, is provided as an individual (monocistronic) mRNA, which is administered separately.

As with the (pharmaceutical) composition according to the present invention, the entities of the vaccine may be provided in liquid and or in dry (e.g. lyophilized) form. They may contain further components, in particular further components allowing for its pharmaceutical use. The vaccine or the (pharmaceutical) composition may, e.g., additionally contain a pharmaceutically acceptable carrier and/or further auxiliary substances and additives and/or adjuvants.

The vaccine or (pharmaceutical) composition typically comprises a safe and effective amount of the mRNA according to the invention as defined herein, encoding an antigenic peptide or protein as defined herein or a fragment or variant thereof or a combination of antigens, preferably as defined herein. As used herein, "safe and effective amount" means an amount of the mRNA that is sufficient to significantly induce a positive modification of cancer or a disease or disorder related to cancer. At the same time, however, a "safe and effective amount" is small enough to avoid serious side-effects, that is to say to permit a sensible relationship between advantage and risk. The determination of these limits typically lies within the scope of sensible medical judgment. In relation to the vaccine or (pharmaceutical) composition of the present invention, the expression "safe and effective amount" preferably means an amount of the mRNA (and thus of the encoded antigen) that is suitable for stimulating the adaptive immune system in such a manner that no excessive or damaging immune reactions are achieved but, preferably, also no such immune reactions below a measurable level. Such a "safe and effective amount" of the mRNA of the (pharmaceutical) composition or vaccine as defined herein may furthermore be selected in dependence of the type of mRNA, e.g. monocistronic, bi- or even multicistronic mRNA, since a bi- or even multicistronic mRNA may lead to a significantly higher expression of the encoded antigen(s) than the use of an equal amount of a monocistronic mRNA. A "safe and effective amount" of the mRNA of the (pharmaceutical) composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the mRNA of the (pharmaceutical) composition, vaccine or kit of parts according to the invention is provided in lyophilized form. Preferably, the lyophilized mRNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition, the vaccine or the kit of parts according to the invention contains at least one, two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or (pharmaceutical) composition according to the invention may typically contain a pharmaceutically acceptable carrier. The expression "pharmaceutically acceptable carrier" as used herein preferably includes the liquid or non-liquid basis of the inventive vaccine. If the inventive vaccine is provided in liquid form, the carrier will be water, typically pyrogen-free water;

isotonic saline or buffered (aqueous) solutions, e.g phosphate, citrate etc. buffered solutions. Particularly for injection of the inventive vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, Na2CO3, NaHCO3, Na2SO4, examples of the optional potassium salts include e.g. KCl, KI, KBr, K2CO3, KHCO3, K2SO4, and examples of calcium salts include e.g. CaCl2, CaI2, CaBr2, CaCO3, CaSO4, Ca(OH)2. Furthermore, organic anions of the aforementioned cations may be contained in the buffer. According to a more preferred embodiment, the buffer suitable for injection purposes as defined above, may contain salts selected from sodium chloride (NaCl), calcium chloride (CaCl2) and optionally potassium chloride (KCl), wherein further anions may be present additional to the chlorides. CaCl2 can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride (CaCl2). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive vaccine are capable of being mixed with the mRNA according to the invention as defined herein, in such a manner that no interaction occurs, which would substantially reduce the pharmaceutical effectiveness of the inventive vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, casts and storability, which are not critical for the purposes of the present invention, and can be made without difficulty by a person skilled in the art.

The inventive vaccine or composition can additionally contain one or more auxiliary substances in order to further increase the immunogenicity. A synergistic action of the mRNA contained in the inventive composition and of an auxiliary substance, which may be optionally be co-formulated (or separately formulated) with the inventive vaccine or composition as described above, is preferably achieved thereby. Depending on the various types of auxiliary substances, various mechanisms may play a role in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CO-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Application and Medical Use:

According to one aspect of the present invention, the mRNA sequence, the (pharmaceutical) composition or the vaccine may be used according to the invention (for the preparation of a medicament) for the treatment or prophylaxis of Norovirus infections or disorders related thereto.

In this context, also included in the present invention are methods of treating or preventing Norovirus infections or disorders related thereto, preferably as defined herein, by administering to a subject in need thereof a pharmaceutically effective amount of the mRNA sequence, the (pharmaceutical) composition or the vaccine according to the invention. Such a method typically comprises an optional first step of preparing the mRNA sequence, the composition or the vaccine of the present invention, and a second step, comprising administering (a pharmaceutically effective amount of) said composition or vaccine to a patient/subject in need thereof. A subject in need thereof will typically be a mammal. In the context of the present invention, the mammal is preferably selected from the group comprising, without being limited thereto, e.g. goat, cattle, swine, dog, cat, donkey, monkey, ape, a rodent such as a mouse, hamster, rabbit and, particularly, human. A subject in need thereof may also be a non-mammalian vertebrate, e.g. a bird (chicken).

The invention also relates to the use of the mRNA sequence, the composition or the vaccine according to the invention, preferably for eliciting an immune response in a mammal, preferably for the treatment or prophylaxis of Norovirus infections or a related condition as defined herein.

The present invention furthermore comprises the use of the mRNA sequence, the (pharmaceutical) composition or the vaccine according to the invention as defined herein for modulating, preferably for inducing or enhancing, an immune response in a mammal as defined herein, more preferably for preventing and/or treating Norovirus infections, or of diseases or disorders related thereto. In this context, support of the treatment or prophylaxis of Norovirus infections may be any combination of a conventional Norovirus therapy method such as therapy with antivirals such as neuraminidase inhibitors (e.g. oseltamivir and zanamivir) and M2 protein inhibitors (e.g. adamantane derivatives), and a therapy using the RNA or the pharmaceutical composition as defined herein. Support of the treatment or prophylaxis of Norovirus infections may be also envisaged in any of the other embodiments defined herein. Accordingly, any use of the mRNA sequence, the (pharmaceutical) composition or the vaccine according to the invention in co-therapy with any other approach, preferably one or more of the above therapeutic approaches, in particular in combination with antivirals is within the scope of the present invention.

For administration, preferably any of the administration routes may be used as defined herein. In particular, an administration route is used, which is suitable for treating or preventing an Norovirus infection as defined herein or diseases or disorders related thereto, by inducing or enhancing an adaptive immune response on the basis of an antigen encoded by the mRNA sequence according to the invention. Administration of the composition and/or the vaccine according to the invention may then occur prior, concurrent and/or subsequent to administering another composition and/or vaccine as defined herein, which may in addition contain another mRNA sequence or combination of mRNA sequences encoding a different antigen or combination of antigens, wherein each antigen encoded by the mRNA sequence according to the invention is preferably suitable for the treatment or prophylaxis of Norovirus infections and diseases or disorders related thereto. In this context, a treatment as defined herein may also comprise the modulation of a disease associated to Norovirus infection and of diseases or disorders related thereto.

According to a preferred embodiment of this aspect of the invention, the (pharmaceutical) composition or the vaccine according to the invention is administered by injection. Any suitable injection technique known in the art may be employed. Preferably, the inventive composition is administered by injection, preferably by needle-less injection, for example by jet-injection.

In one embodiment, the inventive composition comprises at least one, two, three, four, five, six, seven, eight, nine, ten, eleven, twelve or more mRNAs as defined herein, each of which is preferably injected separately, preferably by needle-less injection. Alternatively, the inventive composition comprises at least one, two, three, four, five, six, seven, eight, nine, ten, eleven, twelve, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more mRNAs, wherein the at least one, two, three, four, five, six, seven, eight, nine, ten, eleven, twelve, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more mRNAs are administered, preferably by injection as defined herein, as a mixture.

The immunization protocol for the immunization of a subject against an antigen or a combination of at least two, three, four, five, six, seven, eight, nine, ten, eleven, twelve or more antigens as defined herein typically comprises a series of single doses or dosages of the (pharmaceutical) composition or the vaccine according to the invention. A single dosage, as used herein, refers to the initial/first dose, a second dose or any further doses, respectively, which are preferably administered in order to "boast" the immune reaction. In this context, each single dosage preferably comprises the administration of the same antigen or the same combination of antigens as defined herein, wherein the interval between the administration of two single dosages can vary from at least one day, preferably 2, 3, 4, 5, 6 or 7 days, to at least one week, preferably 2, 3, 4, 5, 6, 7 or 8 weeks. The intervals between single dosages may be constant or vary over the course of the immunization protocol, e.g. the intervals may be shorter in the beginning and longer towards the end of the protocol. Depending on the total number of single dosages and the interval between single dosages, the immunization protocol may extend over a period of time, which preferably lasts at least one week, more preferably several weeks (e.g. 2, 3, 4, 5, 6, 7, 8, 9, 10, 11 or 12 weeks), even mare preferably several months (e.g. 3, 4, 5, 6, 7, 8, 9, 10, 11, 12, 18 or 24 months). Each single dosage preferably encompasses the administration of an antigen, preferably of a combination of at least two, three, four, five, six, seven, eight, nine, ten, eleven, twelve or more antigens as defined herein and may therefore involve at least one, preferably 1, 2, 3, 4, 5, 6, 7, 8, 9, 10, 11 or 12 injections. In some cases, the composition or the vaccine according to the invention is administered as a single dosage typically in one injection. In the case, where the vaccine according to the invention comprises separate mRNA formulations encoding distinct antigens as defined herein, the minimum number of injections carried out during the administration of a single dosage corresponds to the number of separate components of the vaccine. In certain embodiments, the administration of a single dosage may encompass more than one injection for each component of the vaccine (e.g. a specific mRNA formulation comprising an mRNA encoding, for instance, one antigenic peptide or protein as defined herein). For example, parts of the total volume of an individual component of the vaccine may be injected into different body parts, thus involving more than one injection. In a more specific example, a single dosage of a vaccine comprising four separate mRNA formulations, each of which is administered in two different body parts, comprises eight injections. Typically, a single dosage comprises all injections required to administer all components of the vaccine, wherein a single component may be involve more than one injection as outlined above. In the case, where the administration of a single dosage of the vaccine according to the invention encompasses more than one injection, the injection are carried out essentially simultaneously or concurrently, i.e. typically in a time-staggered fashion within the time-frame that is required for the practitioner to carry out the single injection steps, one after the other. The administration of a single dosage therefore preferably extends over a time period of several minutes, e.g. 2, 3, 4, 5, 10, 15, 30 or BD minutes.

Administration of the mRNA sequence as defined herein, the (pharmaceutical) composition or the vaccine according to the invention may be carried out in a time staggered treatment. A time staggered treatment may be e.g. administration of the mRNA sequence, the composition or the vaccine prior, concurrent and/or subsequent to a conventional therapy of Norovirus infections or diseases or disorders related thereto, e.g. by administration of the mRNA sequence, the composition or the vaccine prior, concurrent and/or subsequent to a therapy or an administration of a therapeutic suitable for the treatment or prophylaxis of Norovirus infections or diseases or disorders related thereto. Such time staggered treatment may be carried out using e.g. a kit, preferably a kit of parts as defined herein.

Time staggered treatment may additionally or alternatively also comprise an administration of the mRNA sequence as defined herein, the (pharmaceutical) composition or the vaccine according to the invention in a form, wherein the mRNA encoding an antigenic peptide or protein as defined herein or a fragment or variant thereof, preferably forming part of the composition or the vaccine, is administered parallel, prior or subsequent to another mRNA sequence encoding an antigenic peptide or protein as defined above, preferably forming part of the same inventive composition or vaccine. Preferably, the administration (of all mRNA sequences) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

In a preferred embodiment, the pharmaceutical composition or the vaccine of the present invention is administered repeatedly, wherein each administration preferably comprises individual administration of the at least one mRNA of the inventive composition or vaccine. At each time point of administration, the at least one mRNA may be administered more than once (e.g. 2 or 3 times). In a particularly preferred embodiment of the invention, at least two, three, four, five, six or more mRNA sequences (each encoding a distinct one of the antigens as defined herein) are administered at each time point, wherein each mRNA is administered twice by injection, distributed over the four limbs.

Kit or Kit of Parts:

According to another aspect of the present invention, the present invention also provides a kit, in particular a kit of parts, comprising the mRNA sequence as defined herein, the (pharmaceutical) composition, and/or the vaccine according to the invention, optionally a liquid vehicle for solubilising and optionally technical instructions with information on the administration and dosage of the mRNA sequence, the composition and/or the vaccine. The technical instructions may contain information about administration and dosage of the mRNA sequence, the composition and/or the vaccine. Such kits, preferably kits of parts, may be applied e.g. for any of the above mentioned applications or uses, preferably for the use of the mRNA sequence according to the invention (for the preparation of an inventive medicament, preferably a vaccine) for the treatment or prophylaxis of Norovirus infections or diseases or disorders related thereto. The kits may also be applied for the use of the mRNA sequence, the composition or the vaccine as defined herein (for the preparation of an inventive vaccine) for the treatment or prophylaxis of Norovirus infections or diseases or disorders related thereto, wherein the mRNA sequence, the composition and/or the vaccine may be capable of inducing or enhancing an immune response in a mammal as defined above. Such kits may further be applied for the use of the mRNA sequence, the composition or the vaccine as defined herein (for the preparation of an inventive vaccine) for modulating, preferably for eliciting, e.g. to induce or enhance, an immune response in a mammal as defined above, and preferably for supporting treatment or prophylaxis of Norovirus infections or diseases or disorders related thereto. Kits of parts, as a special form of kits, may contain one or more identical or different compositions and/or one or more identical or different vaccines as described herein in different parts of the kit. Kits of parts may also contain an (e.g. one) composition, an (e.g. one) vaccine and/or the mRNA sequence according to the invention in different parts of the kit, e.g. each part of the kit containing an mRNA sequence as defined herein, preferably encoding a distinct antigen. Preferably, the kit or the kit of parts contains as a part a vehicle for solubilising the mRNA according to the invention, the vehicle preferably being Ringer-lactate solution. Any of the above kits may be used in a treatment or prophylaxis as defined above.

In another embodiment of this aspect, the kit according to the present invention may additionally contain at least one adjuvant. In a further embodiment, the kit according to the present invention may additionally contain at least one further pharmaceutically active component, preferably a therapeutic compound suitable for treatment and/or prophylaxis of cancer or a related disorder. Moreover, in another embodiment, the kit may additionally contain parts and/or devices necessary or suitable for the administration of the composition or the vaccine according to the invention, including needles, applicators, patches, injection-devices.

Preferred Items:

In one embodiment the invention relates to subject matter summarized as follows:

Item 1. Artificial nucleic acid comprising at least one coding region encoding at least one polypeptide derived from a Norovirus, and/or a fragment or variant thereof.

Item 2. The artificial nucleic acid according to item 1, wherein the at least one encoded polypeptide is selected from the group consisting of a non-structural protein derived from a Norovirus and/or a capsid protein derived from a Norovirus, and/or a fragment or variant thereof.

Item 3. The artificial nucleic acid according to item 1 or 2, wherein the at least one encoded polypeptide is selected from the group consisting of Norovirus non-structural proteins NS1/NS2, NS3, NS4, NS5, NS6, NS7, Norovirus capsid protein VP1 and Norovirus capsid protein VP2, and/or a fragment or variant thereof.

Item 4. The artificial nucleic acid according to any one of items 1 to 3, wherein the artificial nucleic acid is derived from a Norovirus selected from the group consisting of genogroup I Norovirus, genogroup II Norovirus, genogroup III Norovirus, genogroup IV Norovirus, and genogroup V Norovirus; preferably the artificial nucleic acid is derived from a Norovirus selected from the group consisting of a GI.1 to GI.17 Norovirus, GII.1 to GII.24 Norovirus, GIII.1 to GIII.4 Norovirus, GIV.1 to GIV.4 Norovirus and GV.1 to GV.4 Norovirus; more preferably, the artificial nucleic acid is derived from a Norovirus selected from the group consisting of GI.1 Norovirus and GII.4 Norovirus, even more preferably, the artificial nucleic acid is derived from a GII.4 Norovirus, still more preferably, the artificial nucleic acid is derived from a GII.4 CIN-1 Norovirus or a GII.4 Sydney Norovirus or a GII.4 Sydney 2012 Norovirus.

Item 5. The artificial nucleic acid according to any one of items 1 to 4, wherein the at least one encoded polypeptide comprises at least one Norovirus capsid protein VP1 or Norovirus capsid protein VP2 and/or a fragment or a variant thereof.

Item 6. The artificial nucleic acid according to any one of items 1 to 5, wherein the at least one encoded polypeptide comprises at least one Norovirus capsid protein VP1 and/or a fragment or variant thereof.

Item 7. The artificial nucleic acid according to any one of items 1 to 6, wherein the at least one encoded polypeptide comprises (i) at least one of the amino acid sequences according to any one of SEQ ID NOs: 1-4410; and/or (ii) at least one of the amino acid sequences having, in increasing order of preference, at least 50%, 51%, 52%, 53%, 54%, 55%, 50%, 57%, 58%, 59%, 60%, 51%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NOs: 1-4410; and/or (iii) an orthologue or a paralogue of any one of SEQ ID NOs: 1-39090, 39713-39746; and/or a fragment or variant of any of these sequences.

Item 8. The artificial nucleic acid according to any one of items 1 to 7, wherein the at least one coding region comprises (i) at least one of the nucleic acid sequences according to any one of SEQ ID NOs: 4411-39590, 39713-39745; and/or (ii) at least one of the nucleic acid sequences having, in increasing order of preference, at least 50%, 51%, 52%, 53%, 54%, 55%, 56%, 57%, 58%, 59%, 00%, 61%, 62%, 63%, 64%, 65%, GA, 67%, 68%, 69%, 70%, 71%, 72%, 73%, 74%, 75%, 75%, 77%, 78%, 79%, 80%, 81%, 82%, 83%, 84%, 85%, 85%, 87%, 88%, 89%, 90%, 91%, 92%, 93%, 94%, 95%, 96%, 97%, 98%, or 99% sequence identity to the nucleic acid sequence represented by any one of SEQ ID NOs: 4411-39690, 39713-39746; and/or (iii) at least one complement of the nucleic acid sequences which are capable of hybridizing with a nucleic acid sequence comprising a sequence as shown in SEQ ID NOs: 4411-39590, 39713-39746, and/or to a nucleic acid encoding a polypeptide having a sequence as shown in SEQ ID NOs: 1-4410: and/or (iv) an orthologue or a paralogue of any one of SEQ ID NOs: 1-39690, 39713-39746; and/or a fragment or variant of any of these sequences.

Item 9. The artificial nucleic acid according to any one of items 1 to 8, wherein the artificial nucleic acid is monocistronic, bicistronic or multicistronic.

Item 10. The artificial nucleic acid according to any one of items 1 to 9, wherein the artificial nucleic acid is monocistronic and wherein the coding region encodes a polypeptide comprising at least two different Norovirus proteins as defined in any one of items 1 to 9, or a fragment or variant thereof.

Item 11. The artificial nucleic acid according to any one of items 1 to 9, wherein the artificial nucleic acid is bi- or multicistronic and comprises at least two coding regions, wherein the at least two coding regions encode at least two polypeptides, wherein each of the at least two polypeptides comprises at least one Norovirus protein as defined in any one of items 1 to 9, or a fragment or variant of any one of these proteins, wherein the at least two polypeptides are preferably different polypeptides.

Item 12. The artificial nucleic acid according to any one of items 1 to 11, wherein the artificial nucleic acid is an RNA, preferably an mRNA.

Item 13. The artificial nucleic acid according to any one of items 1 to 12, wherein the artificial nucleic acid comprises a 5'-cap structure.

Item 14. The artificial nucleic acid according to any one of items 1 to 13, wherein the G/C content of the coding region of the mRNA sequence is increased compared to the G/C content of the corresponding coding sequence of the wild type mRNA, or wherein the C content of the coding region of the mRNA sequence is increased compared to the C content of the corresponding coding sequence of the wild type mRNA, or wherein the codon usage in the coding region of the mRNA sequence is adapted to the human codon usage, or wherein the codon adaptation index (CAI) is increased or maximised in the coding region of the mRNA sequence, wherein the encoded amino acid sequence of the mRNA sequence is preferably not being modified compared to the encoded amino acid sequence of the wild type mRNA.

Item 15. The artificial nucleic acid according to any one of items 1 to 14, wherein (i) the at least one coding region comprises a nucleic acid sequence, which is codon-optimized; and/or (ii) wherein the at least one coding sequence comprises a nucleic acid sequence, which is identical or at least 50%, BA, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 8821-13230, 26461-39690, 39715, 39716, 39717, 39720, 39721, 39724, 39725, 39728, 39729, 39730, 39733, 39734, 39737, 39738, 39741, 39742, 39745 and 39746, or a fragment or variant of any of these sequences; and/or (iii) wherein the at least one coding sequence comprises a nucleic acid sequence, which is identical or at least 50%, 80%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 13231-17840, or a fragment or variant of any of these sequences; and/or (iv) the artificial nucleic acid according to any one of the preceding items, wherein the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 17641-22050, or a fragment or variant of any of these sequences; and/or (v) the artificial nucleic acid according to any one of the preceding items, wherein the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 22051-26460, or a fragment or variant of any of these sequences.

Item 16. The artificial nucleic acid according to any one of items 1 to 15, wherein the artificial nucleic acid comprises at least one histone stem-loop.

Item 17. The artificial nucleic acid according to item 16, wherein the at least one histone stem-loop comprises a nucleic acid sequence according to the following formulae (I) or (II):

formula (I) (stem-loop sequence without stem bordering elements):

$$\underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}$$

formula (II) (stem-loop sequence with stem bordering elements):

$$\underbrace{N_{4-5}}_{\substack{\text{stem1}\\ \text{bordering element}}}\ \underbrace{[N_{0-2}GN_{3-5}]}_{\text{stem1}}\ \underbrace{[N_{0-4}(U/T)N_{0-4}]}_{\text{loop}}\ \underbrace{[N_{3-5}CN_{0-2}]}_{\text{stem2}}\ \underbrace{N_{4-5}}_{\substack{\text{stem2}\\ \text{bordering element}}}$$

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein N3-5 is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1N, wherein each N is independently from another selected from a nucleotide selected from A, U, T, G and C or a nucleotide analogue thereof; and wherein C is cytidine or an analogue thereof, and may be optionally replaced by a guanosine or an analogue thereof provided that its complementary nucleotide guanosine in stems is replaced by cytidine;

wherein stem1 and stem2 are capable of base pairing with each other forming a reverse complementary sequence, wherein base pairing may occur between stem1 and stem2, or forming a partially reverse complementary sequence, wherein an incomplete base pairing may occur between stem1 and stem2.

Item 18. The artificial nucleic acid according to item 17, wherein the at least one histone stem-loop comprises a nucleic acid sequence according to the following formulae (Ia) or (IIa):

formula (Ia) (stem-loop sequence without stem bordering elements):

$$\underbrace{[N_{0-1}GN_{3-5}]}_{\text{stem1}}\ \underbrace{[N_{1-3}(U/T)N_{0-2}]}_{\text{loop}}\ \underbrace{[N_{3-5}CN_{0-1}]}_{\text{stem2}}$$

formula (IIa) (stem-loop sequence with stem bordering elements):

$$\underbrace{N_{2-5}}_{\substack{\text{stem1}\\ \text{bordering element}}}\ \underbrace{[N_{0-1}GN_{3-5}]}_{\text{stem1}}\ \underbrace{[N_{1-3}(U/T)N_{0-2}]}_{\text{loop}}\ \underbrace{[N_{3-5}CN_{0-1}]}_{\text{stem2}}\ \underbrace{N_{2-5}}_{\substack{\text{stem2}\\ \text{bordering element}}}$$

Item 19. The artificial nucleic acid according to any one of items 16 to 18, wherein the at least one histone stem loop comprises a nucleic acid sequence according to SEQ ID NO: 39709 to SEQ ID NO: 39710, or a fragment or variant thereof.

Item 20. The artificial nucleic acid molecule according to any one of items 1 to 19, wherein the artificial nucleic acid comprises an untranslated region (UTR).

Item 21. The artificial nucleic acid according to item 20, wherein the artificial nucleic acid comprises a 3'-UTR.

Item 22. The artificial nucleic acid according to item 21, wherein the 3'-UTR comprises at least one heterologous 3'-UTR element.

Item 23. The artificial nucleic acid according to item 21 or 22, wherein the 3'-UTR comprises a poly(A) sequence and/or a poly(C) sequence.

Item 24. The artificial nucleic acid according to item 23, wherein the poly(A) sequence comprises 10 to 200, 10 to 100, 40 to 80 or 50 to 70 adenosine nucleotides, and/or the poly(C) sequence comprises 10 to 200, 10 to 100, 20 to 70, 20 to 60 or 10 to 40 cytosine nucleotides.

Item 25. The artificial nucleic acid according to any one of items 1 to 24, wherein the at least one heterologous 3'-UTR element comprises a nucleic acid sequence derived from a 3'-UTR of a gene, which preferably encodes a stable mRNA, or from a homolog, a fragment or a variant of said gene.

Item 26. The artificial nucleic acid according to any one of items 1 to 25, wherein the at least one heterologous 3'-UTR element comprises a nucleic acid sequence derived from a 3'-UTR of a gene selected from the group consisting of an albumin gene, an α-globin gene, a β-globin gene, a tyrosine hydroxylase gene, a lipoxygenase gene, and a collagen alpha gene, or from a homolog, a fragment or a variant thereof.

Item 27. The artificial nucleic acid according to any one of items 1 to 26, wherein the at least one heterologous 3'-UTR element comprises a nucleic acid sequence derived from a 3'-UTR of an α-globin gene, preferably comprising the corresponding RNA sequence of the nucleic acid sequence according to SEQ ID NO: 39701, or SEQ ID NO: 39702, a homolog, a fragment, or a variant thereof.

Item 28. The artificial nucleic acid according to any one of items 1 to 27, wherein the at least one heterologous 3'-UTR element comprises a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to Genbank Accession number NM_000477.5, or from a fragment or variant thereof.

Item 29. The artificial nucleic acid according to any one of items 1 to 28, wherein the at least one heterologous 3'-UTR element comprises a nucleic acid sequence according to any one of SEQ ID NO: 39703 to SEQ ID NO: 39708, or a homing, a fragment or a variant thereof.

Item 30. The artificial nucleic acid according to any one of items 1 to 29, wherein the artificial nucleic acid comprises a 5'-UTR.

Item 31. The artificial nucleic acid sequence according to any one of items 1 to 3D, wherein the 5'-UTR comprises at least one heterologous 5'-UTR element.

Item 32. The artificial nucleic acid according to any one of items 1 to 31, wherein the at least one heterologous 5'-UTR element comprises a nucleic acid sequence, which is derived from the 5'-UTR of a TDP gene, preferably from a corresponding RNA sequence, or a homolog, a fragment, or a variant thereof, preferably lacking the 5'TOP motif.

Item 33. The artificial nucleic acid according to any one of items 1 to 32, wherein the at least one heterologous 5'-UTR element comprises a nucleic acid sequence, which is derived from a 5'-UTR of a TDP gene encoding a ribosomal protein, preferably from a corresponding RNA sequence, or from a homolog, a fragment or a variant thereof, preferably lacking the 5'TOP motif.

Item 34. The artificial nucleic acid according to any one of items 1 to 33, wherein the at least one heterologous 5'-UTR element comprises a nucleic acid sequence, which is derived from a 5'-UTR of a TOP gene encoding a ribosomal Large protein (RPL), preferably RPL32 or RPL35A, or from a gene selected from the group consisting of HSD17B4, ATP5A1, AIG1, ASAH1, COX6C or ABCB7 (MDR), or from a homolog, a fragment or variant of any one of these genes, preferably lacking the 5'TOP motif.

Item 35. The artificial nucleic acid according to any one of items 1 to 34, wherein the at least one heterologous 5'-UTR element comprises a nucleic acid sequence according to SEQ ID NO: 39691 to SEQ ID NO: 39694, or a homolog, a fragment or a variant thereof.

Item 36. The artificial nucleic acid according to any one of items 1 to 35 comprising, preferably in 5' to 3' direction, the following elements:

a) optionally a 5'-cap structure, preferably m7GpppN,
b) a coding region encoding at least one polypeptide derived from a Norovirus as described herein, preferably VP1, or a fragment or variant thereof,
c) optionally a poly(A) tail, preferably consisting of 10 to 200, 10 to 100, 40 to 80 or 50 to 70 adenosine nucleotides,
d) optionally a poly(C) tail, preferably consisting of 10 to 200, 10 to 100, 20 to 70, 20 to 60 or 10 to 40 cytosine nucleotides, and
e) optionally a histone stem-loop, preferably comprising the RNA sequence according to SEQ ID NO: 39709 to SEQ ID NO: 39710.

Item 37. The artificial nucleic acid according to any one of items 1 to 36 comprising, preferably in 5' to 3' direction, the following elements:

a) optionally a 5'-cap structure, preferably m7GpppN,
b) a coding region encoding at least one polypeptide derived from a Norovirus, preferably VP1 as described herein, or a fragment or variant thereof,
c) a 3'-UTR element comprising a nucleic acid sequence, which is derived from an α-globin gene, preferably comprising the corresponding RNA sequence of the nucleic acid sequence according to SEQ ID NO: 39701, or SEQ ID NO: 39702, or a homolog, a fragment or a variant thereof,
d) optionally a poly(A) tail, preferably consisting of 10 to 200, 10 to 100, 40 to 80 or 50 to 70 adenosine nucleotides,
e) optionally a poly(C) tail, preferably consisting of 10 to 200, 10 to 100, 20 to 70, 20 to 60 or 10 to 40 cytosine nucleotides, and
f) optionally a histone stem-loop, preferably comprising the RNA sequence according to SEQ ID NO: 39709 to SEQ ID NO: 39710.

Item 38. The artificial nucleic acid according to any one of items 1 to 37, wherein the artificial nucleic acid comprises a nucleic acid sequence according to any one of SEQ ID NO: 39713-39749, preferably a nucleic acid sequence according to any one of SEQ ID NO: 39719, 39721, 39729, 39734, 39738, 39725, or a fragment or variant of any of these sequences.

Item 39. The artificial nucleic acid according to any one of items 1 to 38, comprising, preferably in 5' to 3' direction, the following elements:

a) optionally a 5'-cap structure, preferably m7GpppN,
b) a 5'-UTR element, which comprises or consists of a nucleic acid sequence, which is derived from the 5'-UTR of a TOP gene, preferably comprising a nucleic acid sequence according to SEQ ID NO: 39991, or SEQ ID NO: 39692, or a homolog, a fragment or a variant thereof,
c) a coding region encoding at least one polypeptide derived from a Norovirus, preferably VP1 as described herein, or a fragment or variant thereof,
d) a 3'-UTR element comprising a nucleic acid sequence, which is derived from an albumin gene, preferably comprising the corresponding RNA sequence of the nucleic acid sequence according to SEQ ID NO: 39705, or SEQ ID NO: 39706, or a homolog, a fragment or a variant thereof,
e) optionally a poly(A) tail, preferably consisting of 10 to 200, 10 to 100, 40 to 80 or 50 to 70 adenosine nucleotides, f) optionally a poly(C) tail, preferably consisting of 10 to 200, 10 to 100, 20 to 70, 20 to 60 or 10 to 40 cytosine nucleotides, and g) optionally a histone stem-loop, preferably comprising the RNA sequence according to SEQ ID NO: 39709 to SEQ ID NO: 39710.

Item 40. The artificial nucleic acid according to any one of items 1 to 39, wherein the artificial nucleic acid comprises a nucleic acid sequence according to any one of SEQ ID NOs: 39713-39746, preferably a nucleic acid sequence according to any one of SEQ ID NOs: 39716, 39721, 39729, 39734, 39738, 39725, or a fragment or variant of any of these sequences.

Item 41. The artificial nucleic acid according to any one of items 1 to 40, wherein the coding region comprises a modified nucleic acid sequence.

Item 42. The artificial nucleic acid according to any one of items 1 to 41, wherein the at least one coding region comprises a nucleic acid sequence encoding a molecular tag and wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

Item 43. Composition comprising at least one artificial nucleic acid as defined by any one of items 1 to 42 and a pharmaceutically acceptable carrier.

Item 44. The composition according to item 43, wherein the at least one mRNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

Item 45. The composition according to any one of items 43 to 44, wherein the N/P ratio of the at least one mRNA to the one or more cationic or polycationic compounds is in the range of about 0.1 to 20, including a range of about 0.3 to 4, of about 0.5 to 2, of about 0.7 to 2 and of about 0.7 to 1.5.

Item 46. The composition according to any one of items 43 to 45 comprising the at least one mRNA, which is complexed with one or mare cationic or polycationic compounds, and at least one free mRNA.

Item 47. The composition according to any one of items 43 to 46, wherein the at least one complexed mRNA is identical to the at least one free mRNA.

Item 48. The composition according to any one of items 43 to 47, wherein the mRNA is complexed with one or more lipids, thereby forming liposomes, lipid nanoparticles and/or lipoplexes.

Item 49. The composition according to any one of items 43 to 48, wherein the composition comprises at least one adjuvant.

Item 50. The composition according to any one of items 43 to 49, wherein a) the composition comprises a plurality or more than one of the mRNA sequences each defined in any one of items 1 to 42;

or b) the composition comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more artificial nucleic acids as defined by any one of items 1 to 42, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more artificial nucleic acids comprises at least one coding region encoding at least one polypeptide comprising a Norovirus protein as defined in any one of items 1 to 42, and/or a fragment or a variant of any one of these proteins, wherein each coding region preferably encodes a different Norovirus protein, more preferably each coding region encodes a capsid protein, preferably VP1 of a different Norovirus.

Item 51. The composition according to any one of items 43 to 50, wherein a) wherein each of the mRNA sequences encodes at least one different antigenic peptide or protein derived from proteins of the same Norovirus; and/or b) the composition comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more artificial nucleic acids as defined by any one of items 1 to 42, wherein each of the at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 38, 37, 38, 39, 40, 41, 42, 43, 44, 45, 46, 47, 48, 49, 50 or more artificial nucleic acids comprises at least one coding region encoding at least one polypeptide comprising at least two different Norovirus proteins, preferably VP1 and VP2, as defined in any one of items 1 to 42, and/or a fragment or a variant of any one of these proteins.

Item 52. The composition according to any one of items 43 to 51, wherein the at least one artificial nucleic acid is complexed at least partially with a cationic or polycationic compound and/or a polymeric carrier, preferably a cationic protein or peptide.

Item 53. The composition according to any one of items 43 to 52, wherein (i) the ratio of complexed nucleic acid to free nucleic acid is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w); or (ii) the mRNA is complexed with one or more cationic or polycationic compounds in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w:w) or of about 3:1(w/w) to about 1:1 (w/w), and most preferably a ratio of about 3:1 (w/w) to about 2:1 (w/w) of mRNA to cationic or polycationic compound and/or with a polymeric carrier; or optionally in a nitrogen/phosphate ratio of mRNA to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9;

and/or wherein the at least one artificial nucleic acid or mRNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids and/or wherein the at least one artificial nucleic acid or mRNA is complexed with one or more lipids and thereby forming liposomes, lipid nanoparticles and/or lipoplexes.

Item 54. The composition according to any one of items 43 to 53 wherein the composition comprises (i) at least 2, 3, 4, 5, 6, 7, 8, 9, 10 or more artificial nucleic acids as defined in items 1 to 42; or (ii) at least 10, 15, 20 or 50 artificial nucleic acids as defined in items 1 to 42; or (iii) 2-10, 10-15, 15-20, 20-50, 50-100 or 100-200 artificial nucleic acids as defined in items 1 to 42;

and a pharmaceutically acceptable carrier, wherein preferably the artificial nucleic acid encodes a capsid protein VP1 derived from a Norovirus.

Item 55. The composition according to any one of items 43 to 54, wherein (i) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI Noroviruses; or (ii) the artificial nucleic acids are derived from a single GII Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or mare different 011 Noroviruses; or (iii) the artificial nucleic acids are derived from a single GIII Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GIII Noroviruses; or (iv) the artificial nucleic acids are derived from a single G1V Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GIV Noroviruses; or (v) the artificial nucleic acids are derived from a single GU Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GV Noroviruses; or (vi) the artificial nucleic acids are derived from a single GI Norovirus and additionally from a single GII Norovirus, GIII Norovirus, DIV Norovirus and/or GV Norovirus; or (vii) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI Noroviruses and additionally from a single GII, GIII, GIV or GV Norovirus and/or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 and/or more GII, GIII, GIV or GV Noroviruses;

wherein preferably the artificial nucleic acids encode a capsid protein VP1 derived from a Norovirus.

Item 56. The composition according to any one of items 43 to 55, wherein (i) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 49, 47, 48, 49, 50 or more different GI.1 Noroviruses; or (ii) the artificial nucleic acids are derived from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GII.4 Noroviruses; or (iii) the artificial nucleic acids are derived from a single GI.1 Norovirus and additionally from a single GII.4 Norovirus; or (iv) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI.1 Noroviruses and additionally from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more GII.4 Noroviruses; and/or wherein (i) at least one of the nucleic acid sequences according to any one of SEQ ID NO: 39713 to SEQ ID NO: 39746; and/or (ii) at least one of the nucleic acid sequences having, in increasing order of preference, at least 50%, 51%, 52%, 53%, 54%, 55%, 56%, 57%, 58%, 59%, 90%, 91%, 62%, 63%, 64%, 65%, 69%, 67%, 98%, 69%, 70%, 71%, 72%, 73%, 74%, 75%, 76%, 77%, 78%, 79%, 80%, 81%, 82%, 83%, 84%, 85%, 89%, 87%, 88%, 89%, 90%, 91%, 92%, 93%, 94%, 95%, 96%, 97%, 98%, or 99% sequence identity to the nucleic acid sequence represented by any one of SEQ ID NO: 39713 to SEQ ID NO: 39749; and/or (iii) at least one complement of the nucleic acid sequences which are capable of hybridizing with a nucleic acid sequence comprising a sequence as shown in SEQ ID NO: 39713 to SEQ ID NO: 39746; and/or (iv) an orthologue or a paralogue of any one of SEQ ID NO: 39713 to SEQ ID NO: 39746; and/or a fragment or variant of any of these sequences.

Item 57. Polypeptide encoded by the artificial nucleic acid according to any one of items 1 to 42.

Item 58. Polypeptide according to any one of items 1 to 42 comprising at least one protein selected from the group consisting of NS1/NS2, NS3, NS4, NS5, NS6, NS7, VP1, and VP2 derived from Norovirus, or a fragment or variant of any of these proteins, and at least one amino acid sequence selected from the group consisting of:

a) an amino acid sequence derived from a C-terminal fragment from mature Norovirus capsid protein VP1, or a variant thereof, wherein the C-terminal fragment consists of 3 to 20 amino acid residues, b) an amino acid sequence derived from a signal sequence of Norovirus capsid protein VP1, or a fragment or variant thereof, and c) an amino acid sequence derived from an N-terminal fragment from mature Norovirus non-structural protein NS1/NS2, NS3, NS4, NS5, NS6, or NS7, or a variant thereof, wherein the N-terminal fragment consists of 3 to 20 amino acid residues.

Item 59. The polypeptide according to any one of items 57 to 58 comprising a molecular tag, wherein the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

Item 60. Composition comprising the polypeptide according to any one of items 57 to 59, and a pharmaceutically acceptable carrier.

Item 61. Vaccine comprising the artificial nucleic acid according to any one of items 1 to 42, the composition according to any one of items 43 to 56, the polypeptide according to any one of items 57 to 59, and/or the composition according to item 60.

Item 62. The vaccine according to item 91, wherein the artificial nucleic acid according to any one of items 1 to 42, the composition according to any one of items 43 to 56, the polypeptide according to any one of items 57 to 59, or the composition according to item BD elicits an adaptive immune response.

Item 63. The vaccine according to item 91 to 62, wherein the vaccine further comprises a pharmaceutically acceptable carrier.

Item 64. The vaccine according to any one of items 61 to 63 further comprising an adjuvant.

Item 65. The vaccine according to any one of items GI to 64, wherein the vaccine is multivalent and comprises (i) at least 2, 3, 4, 5, 6, 7, 8, 9, 10 or more artificial nucleic acids as defined in items 1 to 42; or (ii) at least 10, 15, 20 or 50 artificial nucleic acids as defined in items 1 to 42; or (iii) 2-10, 10-15, 15-2E1, 20-50, 50-100 or 100-200 artificial nucleic acids as defined in items 1 to 42.

Item 66. The vaccine according to any one of items 61 to 65, wherein (i) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI Noroviruses; or (ii) the artificial nucleic acids are derived from a single 611 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 39, 37, 38, 39, 40, 41, 42, 43, 44, 45, 46, 47, 48, 49, 50 or more different GII Noroviruses; or (iii) the artificial nucleic acids are derived from a single GIII Norovirus or from 2, 3, 4, 5, ft 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GIII Noroviruses; or (iv) the artificial nucleic acids are derived from a single GIV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GIV Noroviruses; or (v) the artificial nucleic acids are derived from a single GV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GV Noroviruses; or (vi) the artificial nucleic acids are derived from a single GI Norovirus and additionally from a single GII Norovirus, GIII Norovirus, GIV Norovirus and/or GV Norovirus; or (vii) the artificial nucleic acids are derived from a single GI Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI Noroviruses and additionally from a single GII, GIII, GIV and/or GV Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more GII, GIII, GIV and/or GV Noroviruses.

Item 67. The vaccine according to any one of items GI to 66, wherein (i) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI.1 Noroviruses; or (ii) the artificial nucleic acids are derived from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GII.4 Noroviruses; or (iii) the artificial nucleic acids are derived from a single GI.1 Norovirus and additionally from a single GII.4 Norovirus; or (iv) the artificial nucleic acids are derived from a single GI.1 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more different GI.1 Noroviruses and additionally from a single GII.4 Norovirus or from 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more GII.4 Noroviruses.

Item 68. Kit or kit of parts comprising the artificial nucleic acid according to any one of items 1 to 42, the composition according to any one of items 43 to 56, the polypeptide according to any one of items 57 to 59, the composition according to item 60 or the vaccine according to any one of items 61 to 67, optionally comprising a liquid vehicle for solubilising, and optionally technical instructions providing information on administration and dosage of the components.

Item 69. The kit or kit of parts according to item 68 comprising Ringer lactate solution.

Item 70. The artificial nucleic acid according to any one of items 1 to 42, the composition according to any one of items 43 to 56, the polypeptide according to any one of items 57 to 59, the composition according to item 60, the vaccine according to any one of items 61 to 67, or the kit or kit of parts according to item 68 to 69 for use as a medicament.

Item 71. The artificial nucleic acid according to any one of items 1 to 42, the composition according to any one of items 43 to 56, the polypeptide according to any one of items 57 to 59, the composition according to item BO, the vaccine according to any one of items GI to 67, or the kit or kit of parts according to item 68 to 69 for use in the treatment or prophylaxis of an infection with Norovirus or a disorder related to an infection with Norovirus.

Item 72. The artificial nucleic acid according to any one of according to any one of items 1 to 42, the composition according to any one of items 43 to 56, the polypeptide according to any one of items 57 to 59, the composition according to item 60, the vaccine according to any one of items 61 to 67, or the kit or kit of parts according to item 68 to 69, wherein the artificial nucleic acid, the composition, the vaccine or the active component of the kit or kit of parts is administered by injection, preferably by needle-less injection, more preferably by jet injection.

Item 73. The artificial nucleic acid according to any one of items 1 to 42, the composition according to any one of items 43 to 56, the polypeptide according to any one of items 57 to 59, the composition according to item 60, the vaccine according to any one of items 61 to 67, or the kit or kit of parts according to item 68 to 69 for use according to any one of items 70 to 72, wherein the treatment or prophylaxis comprises the administration of a further active pharmaceutical ingredient.

Item 74. Method of treating or preventing a disorder, wherein the method comprises administering to a subject in need thereof the artificial nucleic acid according to any one of items 1 to 42, the composition according to any one of items 43 to 56, the polypeptide according to any one of items 57 to 59, the composition according to item 60, the vaccine according to any one of items 61 to 67, or the kit or kit of parts according to item 68 to 69.

Item 75. The method according to item 74, wherein the disorder is an infection with Norovirus or a disorder related to an infection with Norovirus.

EXAMPLES

Figure 1:
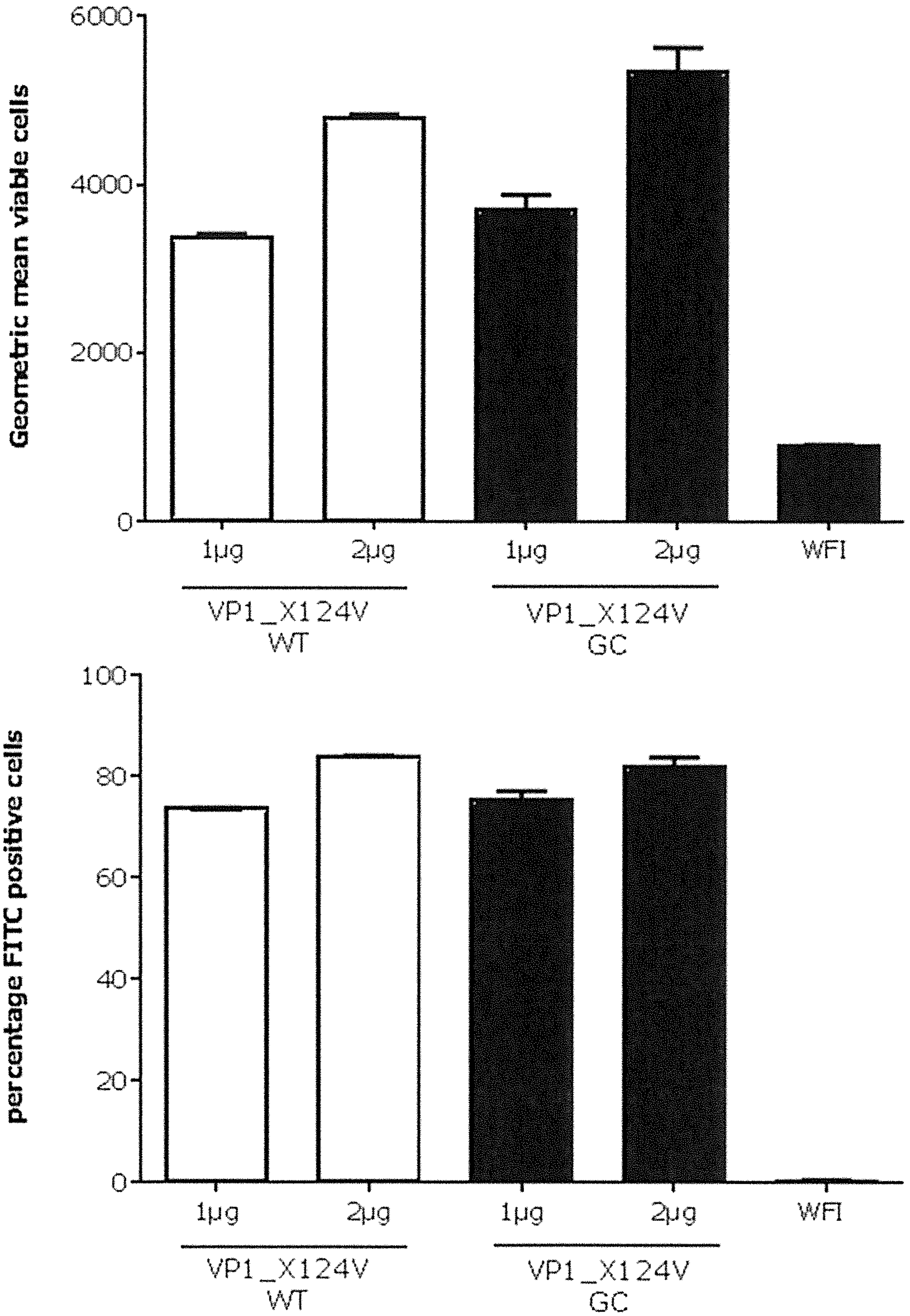
FIG. 1: shows that transfection of HeLa cells with mRNAs coding for Norovirus antigen VP1 leads to the expression of the encoded protein. For cell transfection, mRNA constructs (construct ID R2) and (construct ID R4) were used. Norovirus VP1 proteins were stained intracellularly with a specific anti-Norovirus GII.4 antibody and a FITC labelled secondary antibody and analyzed by FACS. A detailed description of the experiment is provided in the examples section, Example 2.

The Examples shown in the following are merely illustrative and shall describe the present invention in a further way. These Examples shall not be construed to limit the present invention thereto.

Example 1: Preparation of mRNA for In Vitro and In Vivo Experiments 1.1. Preparation of DNA and mRNA Constructs:

For the present examples, DNA sequences encoding Norovirus antigenic proteins, derived from three or more different Norovirus strains were prepared and used for subsequent RNA in vitro transcription reactions. The prepared RNA constructs (coding sequences (cds) and mRNA sequences) are listed in Table 4 below.

Most DNA sequences were prepared by modifying the wild type encoding DNA sequences by introducing a codon modified sequence or GC-optimized sequence for stabilization, using three or more different in silico algorithms that e.g. increase the GC content of the respective coding sequence (indicated as "GC opt 1", "GC opt 2", "GC opt 3", "GC opt 4", "opt 5", "opt 6", "opt 7" in Table 4; further details relating to sequence modifications are provided in the specifications of the invention). Some DNA sequences were used as a wild type coding sequence, without altering the GC content and without altering the codon usage of the coding sequence (indicated as "wt" in Table 4).

DNA sequences were prepared by modifying the wild type encoding DNA sequences by introducing a GC-optimized sequence for stabilization, using an in silica algorithms that increase the GC content of the respective coding sequence (e.g., indicated as "opt1" in Table 4, see explanation in the paragraph above).

Moreover, sequences were introduced into a pUC19 derived vector and modified to comprise stabilizing sequences derived from alpha-globin-3'-UTR, a stretch of 30 cytosines, a histone-stem-loop structure, and a stretch of 64 adenosines at the 3'-terminal end (poly-A-tail), indicated as "design 1" in Table 4. Other sequences were introduced into a pUC19 derived vector to comprise stabilizing sequences derived from 32L4 5'-UTR ribosomal FOP UTR and 3'-UTR derived from albumin 7, a stretch of 30 cytosines, a histone-stem-loop structure, and a stretch of 64 adenosines at the 3'-terminal end (poly-A-tail), indicated as "design 2" in Table 4. Further details are relating mRNA construct design are provided in the specifications of the invention)

The obtained plasmid DNA constructs were transformed and propagated in bacteria (*Escherichia coli*) using common protocols known in the art.

(cationic lipid), phospholipid, cholesterol and a PEGylated lipid. Cationic lipid, DSPC, cholesterol and PEG-lipid are solubilized in ethanol. RNA is diluted to a total concentration of about 0.05 mg/mL in 50 mM citrate buffer pH 4. Syringe pumps are used to mix the ethanolic lipid solution with RNA at a ratio of about 1:6 to 1:2 (vol/vol). Ethanol is then removed and the external buffer replaced with PBS by dialysis. Lipid nanoparticles are filtered through a 0.2 μm pore sterile filter. Lipid nanoparticle particle diameter size may be determined by quasi-elastic light scattering using a Malvern Zetasizer Nano (Malvern, UK).

TABLE 4

VP1 coding sequences, protein sequences and mRNA constructs

| RNA ID | | Construct description | Norovirus strain | RNA design | SEQ ID NO |
|---|---|---|---|---|---|
| R1 | mRNA | VP1_(X124V) | GII.4-031693-USA-2003 | design 1, wt | 39713 |
| R2 | mRNA | VP1_(X124V) | GII.4-031693-USA-2003 | design 2, wt | 39714 |
| R3 | mRNA | VP1_(X124V) | GII.4-031693-USA-2003 | design 1, GC opt 1 | 39715 |
| R4 | mRNA | VP1_(X124V) | GII.4-031693-USA-2003; C1N1 | design 2, GC opt 1 | 39716 |
| R5 | protein | VP1_(X124V) | GII.4-031693-USA-2003 | Protein* | 2358 |
| R6 | cds | VP1_(X124V) | GII.4-031693-USA-2003 | wild type, wt | 6768 |
| R7 | cds | VP1_(X124V) | GII.4-031693-USA-2003 | GC opt 1 | 39717 |
| R8 | cds | VP1_(X124V) | GII.4-031693-USA-2003 | GC opt 2 | 11178 |
| R9 | cds | VP1_(X124V) | GII.4-031693-USA-2003 | opt 5 | 15588 |
| R10 | cds | VP1_(X124V) | GII.4-031693-USA-2003 | opt 6 | 19998 |
| R11 | cds | VP1_(X124V) | GII.4-031693-USA-2003 | opt 7 | 24408 |
| R12 | cds | VP1_(X124V) | GII.4-031693-USA-2003 | GC opt 3 | 28818 |
| R13 | cds | VP1_(X124V) | GII.4-031693-USA-2003 | GC opt 4 | 33228 |
| R14 | mRNA | Capsidprotein | GII.4 Farmington Hills-2002-USA | design 1 | 39718 |
| R15 | mRNA | Capsidprotein | GII.4 Farmington Hills-2002-USA | design 2 | 39719 |
| R16 | mRNA | Capsidprotein | GII.4 Farmington Hills-2002-USA | design 1, GC opt 1 | 39720 |
| R17 | mRNA | Capsidprotein | GII.4 Farmington Hills-2002-USA | design 2, GC opt 1 | 39721 |
| R18 | protein | Capsidprotein | GII.4 Farmington Hills-2002-USA | Protein* | 1487 |
| R19 | cds | Capsidprotein | GII.4 Farmington Hills-2002-USA | wild type | 5897 |
| R20 | cds | Capsidprotein | GII.4 Farmington Hills-2002-USA | GC opt 2 | 10307 |
| R21 | cds | Capsidprotein | GII.4 Farmington Hills-2002-USA | opt 5 | 10307 |
| R22 | cds | Capsidprotein | GII.4 Farmington Hills-2002-USA | opt 6 | 19127 |
| R23 | cds | Capsidprotein | GII.4 Farmington Hills-2002-USA | opt 7 | 23537 |
| R24 | cds | Capsidprotein | GII.4 Farmington Hills-2002-USA | GC opt 3 | 27947 |
| R25 | cds | Capsidprotein | GII.4 Farmington Hills-2002-USA | GC opt 4 | 32357 |
| R26 | mRNA | VP1 | GII.4-2006b 092895-USA-2008 | design 2, GC opt 1 | 39729 |
| R27 | mRNA | VP1 | GII.4-GZ2010-L87-Guangzhou-2011 | design 2, GC opt 1 | 39734 |
| R28 | mRNA | VP1 | GII.4-USA-1997 | design 2, GC opt 1 | 39738 |
| R29 | mRNA | VP1 | GI.1-USA-1968-Capsidprotein | design 2, GC opt 1 | 39725 |

*protein sequence is back translated into RNA according to the above paragraph "G/C content modification"

1.2. RNA In Vitro Transcription:

The DNA plasmids prepared according to paragraph 1.1 were enzymatically linearized using EcoRI and transcribed in vitro using DNA dependent T7 RNA polymerase in the presence of a nucleotide mixture and cap analog (m7GpppG) under suitable buffer conditions. The obtained mRNAs were purified using PureMessenger® (CureVac, Tübingen, Germany: WO 2008/077592 A1) and used for in vitro and in vivo experiments.

1.3. Preparation of Protamine Formulated RNA Vaccine:

The obtained mRNA, e.g. HPLC purified RNA, was complexed with protamine by addition of protamine-trehalose solution to RNA solution at a RNA:protamine weight to weight ratio of 2:1. Then, complexed RNA was mixed with non-complexed RNA in a ratio of 50% free RNA and 50% complexed RNA to obtain formulated RNA. Formulated RNA was used for in viva vaccination experiments.

1.4. Preparation of LNP Formulated RNA Vaccine:

RNA is encapsulated in lipid nanoparticle (LNP) using established protocols known in the art. Briefly, LNP-encapsulated RNA is prepared using an ionizable amino lipid

Example 2: Expression of Norovirus VP1 Antigens in HeLa Cells and Analysis by FACS To determine in vitro protein expression of the inventive Norovirus mRNA constructs, Hela cells were transfected with mRNA constructs encoding Norovirus VP1 antigens and analyzed by intracellular FACS staining. For cell transfection, an mRNA comprising VP1_X124V (GII.4-031693-USA-2003) wild type coding sequence (SEQ ID NO: 39714; construct ID R2) an mRNA comprising VP1_X124V (GII.4-031693-USA-2003) GC-optimized coding sequence (SEQ ID NO: 39716; construct ID R4), an mRNA comprising VP1 (GII.4-2006b 092895-USA-2008) GC-optimized coding sequence (SEQ ID NO: 39729; construct ID R26), an mRNA comprising VP1 (GII.4-GZ2010-L87-Guangzhou-2011) GC-optimized coding sequence (SEQ ID NO: 39734; construct R27) and an mRNA comprising VP1 NOV(GII.4-USA-1997)-Capsidprotein GC-optimized coding sequence (SEQ ID NO: 39738; construct ID R28) were used. The detailed description of the performed experiment is provided below.

HeLa cells were seeded in a 6-well plate at a density of 400,000 cells/well in cell culture medium (RPMI, 10% FCS, 1% L-Glutamine, 1% Pen/Strep), 24 h prior to transfection. Cells were transfected with 1 μg and 2 μg mRNA per construct using lipofectamine 2000 (Invitrogen) as transfection reagent. As a negative control, water for injection (WFI) was used.

24 hours post transfection, transfected HeLa cells were stained with a commercial mouse anti-Norovirus GII.4 antibody [2000-G5] (Abcam; 1:500) and an anti-mouse FITC labelled secondary antibody (F5262 from Sigma; 1:500) after Cytofix/Cytoperm (BD Biosciences) treatment according to manufacturer's protocol. Subsequently, cells were analyzed by flow cytometry (FACS) on a BD FACS Canto II using the FACS Diva software. Quantitative analysis of the fluorescent FITC signal was performed using the FlowJo software package (Tree Star, Inc.). The results of the FACS expression analysis are shown in FIG. 1 and FIG. 2.

Figure 2:
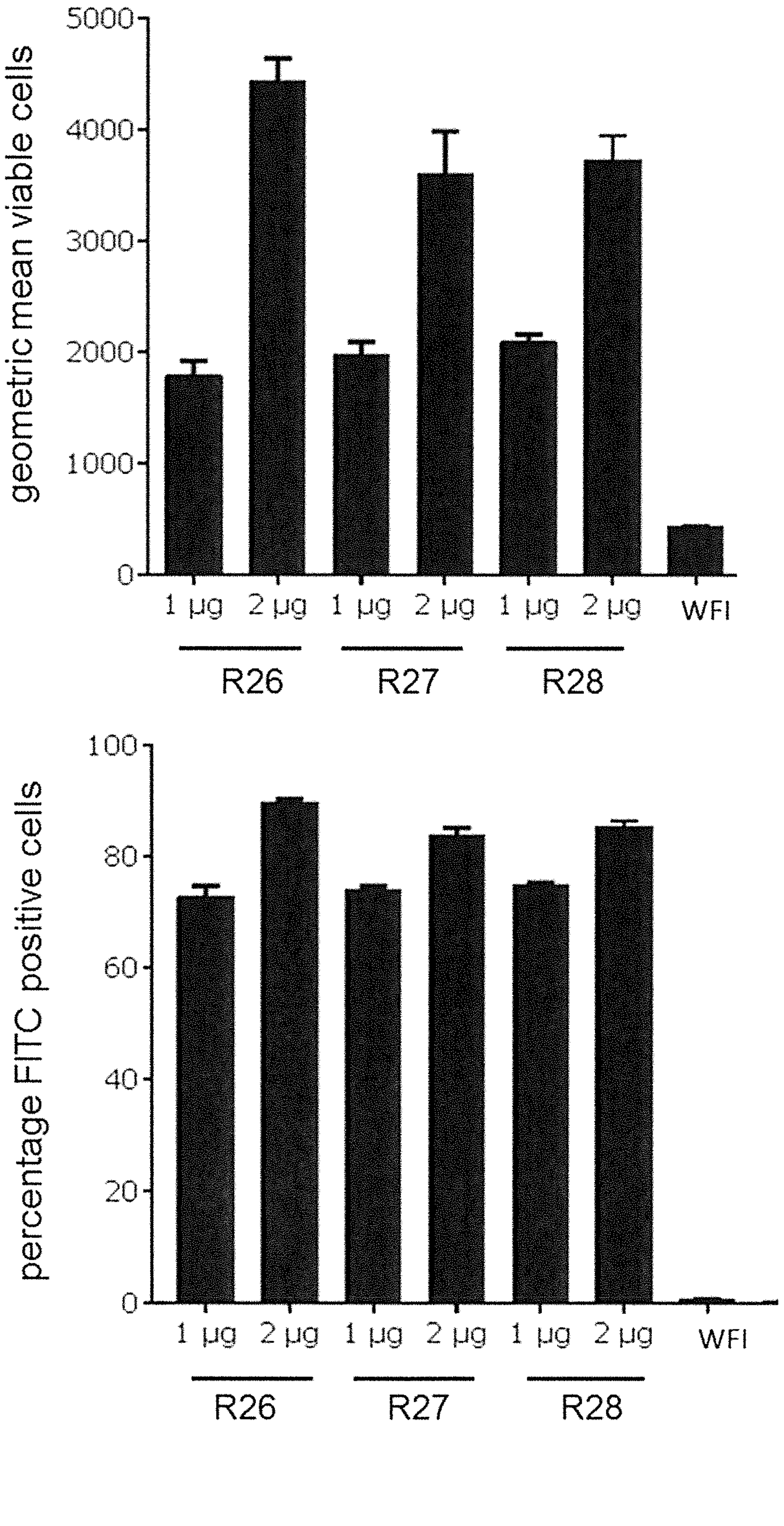
FIG. 2: shows that transfection of HeLa cells with mRNAs coding for Norovirus antigen WI leads to the expression of the encoded protein. For cell transfection, mRNA constructs (construct ID R26), (construct ID R27), and (construct ID R28) were used. Norovirus VP1 proteins were stained with a specific anti-Norovirus GII.4 antibody and a FITC labelled secondary antibody and analyzed by FACS. A detailed description of the experiment is provided in the examples section, Example 2.

Results:

FIG. 1 and FIG. 2 show that the Norovirus proteins were expressed in Ma cells transfected with the mRNA constructs R2, R4, R26, R27 and R28. Overall, around 80%-90% of transfected cells showed positive FITC signal, indicating that the inventive constructs tested here were able to efficiently drive protein expression without affecting cell viability. Of note, the data suggests that analogous mRNA constructs encoding other Norovirus VP1 or VP2 antigens (as defined in the specifications or listed in Table 1 and Table 3) may also drive protein expression in a similar manner.

Example 3: Analysis of Protein Expression Using Western Blot

To determine in vitro protein expression upon HeLa cell transfection with the inventive mRNA constructs, HeLa cells were transiently transfected with an mRNA constructs comprising VP1_X124V coding sequences. Cell lysates were prepared and analyzed using western blot. The detailed description of the performed experiment is provided below.

HeLa cells are transfected with 2 μg mRNA comprising wild type VP1_X124V coding sequence (SEQ ID NO: 39714; construct ID R2) and 2 μg mRNA comprising GC-optimized VP1_X124V coding sequence (SEQ ID NO: 39718; construct ID R4). As a negative control water for injection (WFI) was used. After 24 hours post transfection lysis buffer was added to the culture to prepare cellular lysates. Cellular lysates as well as a commercial Norovirus virus like particle (VLP; obtained from Medigen) were reduced by heating the samples to 95° C. for 10 minute. Subsequently, samples were subjected to SDS-PAGE under denaturating/reducing conditions followed by western blot detection. For the detection of Norovirus proteins, a commercial mouse anti-Norovirus GII.4 antibody [2002-85] (1:250; Abcam) was used as primary antibody followed by secondary goat anti mouse antibody coupled to IRDye 800CW (1:10000; Licor Biosciences). The results of the experiment are shown in FIG. 3.

Figure 3:
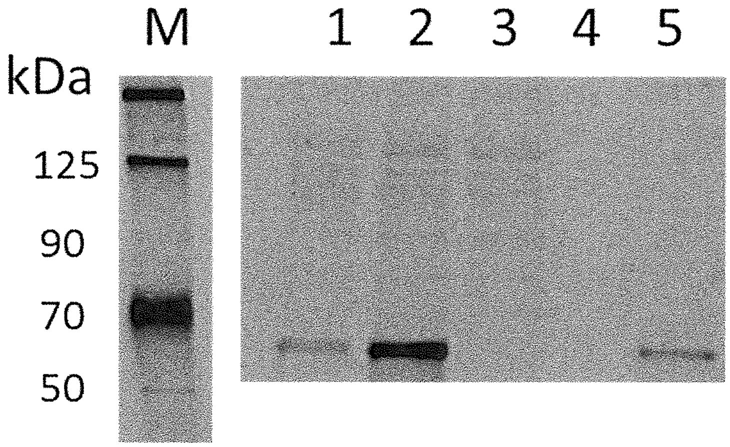
FIG. 3: shows that transfection of HeLa cells with mRNAs coding for Norovirus antigen WI leads to protein expression. For cell transfection, mRNA constructs (construct ID R2) and (construct ID R4) were used. Western blot analysis was performed cell lysates of transfected cells. As a control, a commercial VLP preparation (Medigen; 59 kD) was used. Norovirus VP1 proteins were stained with a specific anti-Norovirus GII.4 antibody. M=marker lane: I=mRNA construct R2; 2=mRNA construct R4; 3=WFI control; 4=empty control; 5=commercial VLP control. A detailed description of the experiment is provided in the examples section, Example 3.

Results:

FIG. 3 shows that the Norovirus proteins were expressed in HeLa cells transfected with the inventive mRNA constructs (SEQ ID NOs: 39714 and 39716). Of note, the data suggests that analogous mRNA constructs encoding other Norovirus antigens (as defined in the specifications or listed in Table 1 and Table 3) may also drive protein expression in a similar manner.

Example 4: Immunization of Mice and Evaluation of Norovirus Specific Immune Responses Female BALB/c mice were immunized intradermally (i.d.) with protamine formulated mRNA vaccine (construct ID R4) with doses, application routes and vaccination schedules as indicated in Table 5. As a negative control, one group of mice was injected with buffer (ringer lactate, RiLa). All animals were vaccinated on day 0, 21 and 35. Blood samples were collected on day 49 for the determination of binding antibody titers (using a homologous and heterologous ELISA assay), blocking antibody titers (using a heterologous HGBA assay) and T-cell responses (intracellular cytokine assay). Detailed descriptions of the performed experiments are provided below.

TABLE 5

Vaccination regimen (Example 4)

| Group | No of mice | Treatment | Dose | Route/Volume | Vaccination schedule |
|---|---|---|---|---|---|
| 1 | 6 | Norovirus GC-optimized VP1_X124V SEQ ID NO: 39716; R4 Protamine formulated | 80 μg | i.d. 2 × 50 μl | d 0, d 21, d 35 |
| 2 | 6 | 100% RiLa Control | | i.m. 1 × 25 μl | d 0, d 21, d 35 |

4.1. Determination of Homologous and Heterologous Immune Responses by ELISA:

ELISA was performed using synthetically produced norovirus Virus like particles (VLP) as coating material. For the analysis of homologous immune responses, plates were coated with VLP of the same strain of genotype GII.4 (GII.4 CIN1). For the analysis of heterologous immune responses, plates were coated with VLPs of another strain of genotype GII.4 (GII.4 2011). Coated plates were incubated using respective serum dilutions, and binding of specific antibodies to the Norovirus coating material was detected using biotinylated isotype specific anti-mouse antibodies followed by streptavidin-HRP (horse radish peroxidase) with ABTS as substrate. Endpoint titers of antibodies were measured by ELISA on day 49 after three vaccinations (see Table 5). The results are shown in FIG. 4A (homologous responses) and FIG. 4B (heterologous responses).

Figure 5:
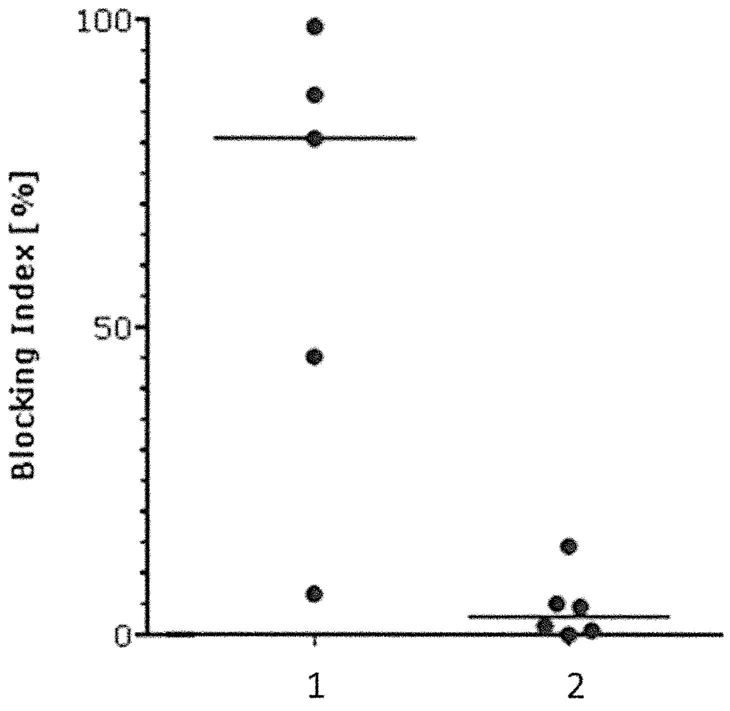
FIG. 5: shows that immunization of mice with formulated Norovirus mRNA vaccine (Norovirus GC-optimized VP1_X124V; construct ID R4; protamine formulated) induced heterologous blocking antibodies. The results of a Histo-Blood Group Antigen (HBGA) assay in serum dilution 1:12.5 are shown. I=group vaccinated with Norovirus mRNA vaccine; 2=buffer control group. A detailed description of the experiment is provided in the examples section, Example 4.2.

4.2. Determination of Blocking Antibody Titers Using a HBGA Blocking Assay:

Respective sera (day 49 after three vaccinations) were pre-incubated with synthetic norovirus VLPs (VLP (GII.4 2011)) and subsequently added to HBGA coated plates. VLP binding to Histo-Blood Group Antigen (HBGA) was detected by norovirus specific antibodies. In the presence of functional blocking antibodies in serum of immunized animals, VLP binding to HBGA was blocked which results in a reduction of the detected antibody signal. The respective blocking index was calculated as commonly known in the art. The results of the assay are shown in FIG. 5.

Figure 6:
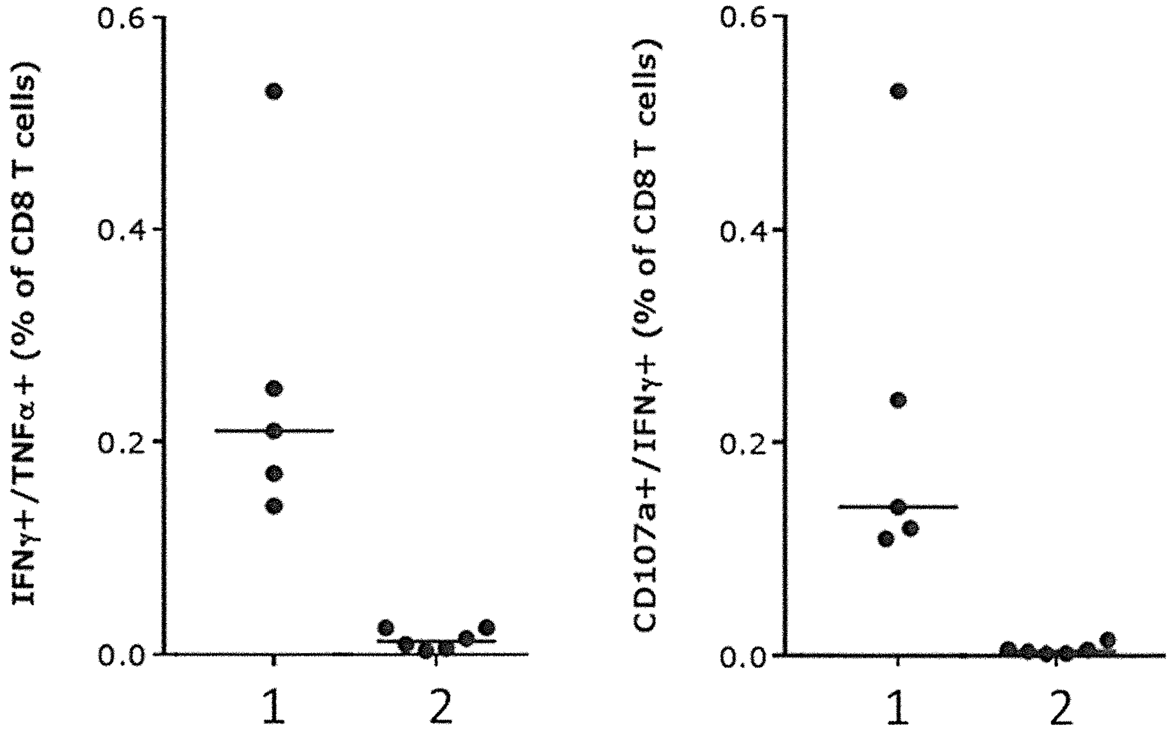
FIG. 6: shows that immunization of mice with formulated Norovirus mRNA vaccine (Norovirus GC-optimized VP1_X124V; construct ID R4; protamine formulated) induced antigen specific T-cell responses. The results of an ICS assay are shown (CD8+ T-cells). 1=group vaccinated with Norovirus mRNA vaccine; 2=buffer control group. A detailed description of the experiment is provided in the examples section, Example 4.3.

4.3. Determination of Specific CD8 T-Cell Responses Using ICS:

Splenocytes from vaccinated mice were isolated according to a standard protocol known in the art. Briefly, isolated spleens were grinded through a cell strainer and washed in PBS/1% FBS followed by red blood cell lysis. After an extensive washing step with PBS/1% FBS splenocytes were seeded into 96-well plates ($2\times10^6$ cells per well). The cells were stimulated with ten Norovirus CD8 peptide epitopes (1 μg/ml of each peptide) in the presence of 2.5 μg/ml of an anti-CD28 antibody (BD Biosciences) and anti-CD107α-PE-Cy7 antibody, after one hour at 37° C. After stimulation, cells were washed and stained and for staining of intracellular cytokines Cytofix/Cytoperm reagent (BD Biosciences) was used according to the manufacturer's instructions. The following antibodies were used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye was used to distinguish live/dead cells (Invitrogen). Cells were acquired using a Canto II flow cytometer (Beckton Dickinson). Flow cytometry data was analyzed using FlowJo software package (Tree Star, Inc.). Results for CD8+ T-cells are shown in FIG. 6.

Figure 4:
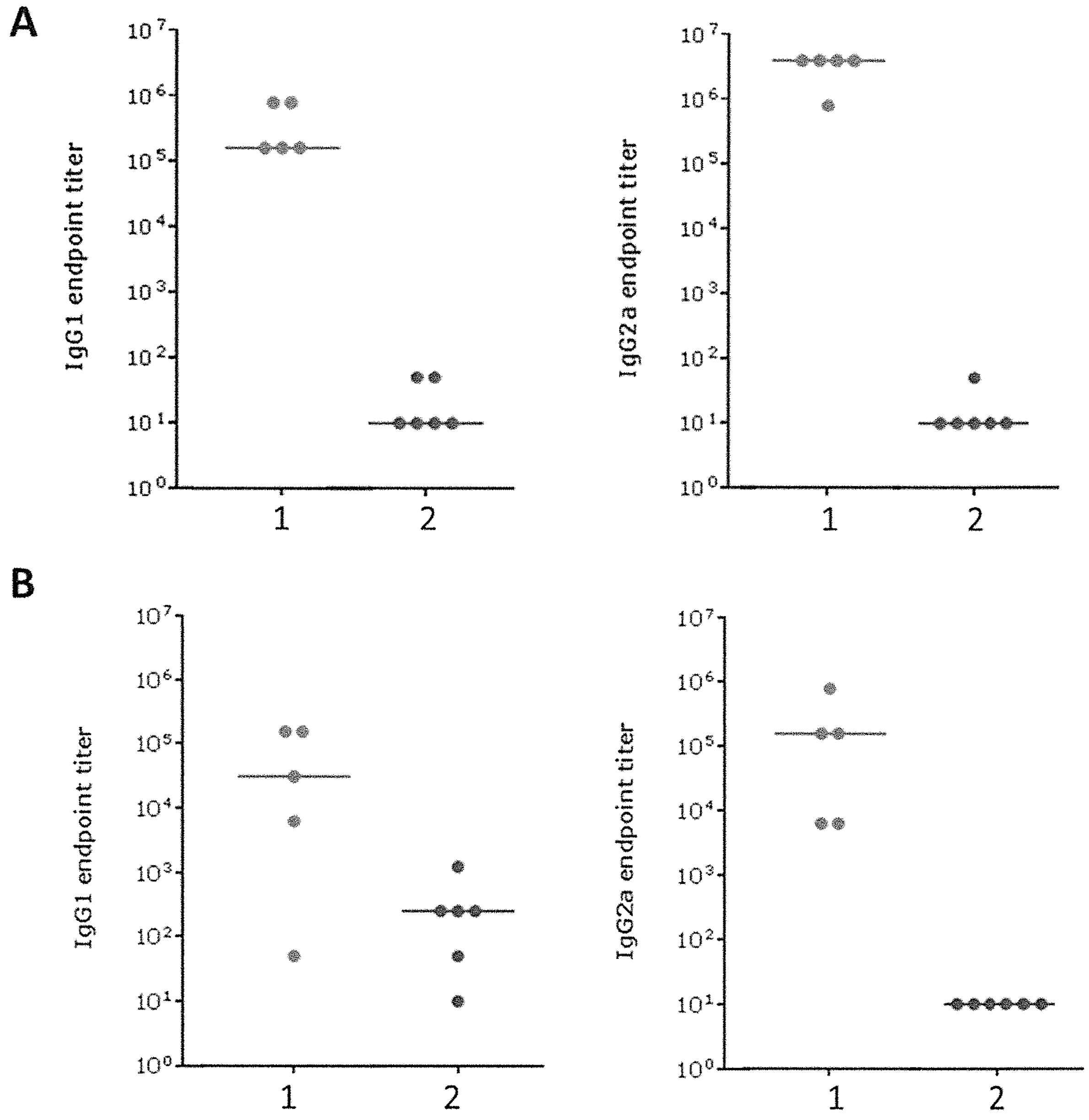
FIG. 4: shows that immunization of mice with formulated Norovirus mRNA vaccine (Norovirus GC-optimized VP1_X124V; construct ID R4; protamine formulated) induced binding IgG1 and IgG2 antibodies, both in a homologous ELISA design (FIG. 4A; coating material VLP GII.4) and in a heterologous ELISA design (FIG. 4B; coating material VLP GII.4 2011). 1=group vaccinated with Norovirus mRNA vaccine; 2=buffer control group. A detailed description of the experiment is provided in the examples section, Example 4.1.

Results:

FIG. 4 shows that the tested Norovirus mRNA vaccine induced Norovirus specific IgG1 and IgG2 antibody titers in immunized mice. Humoral immune response was demonstrated in a homologous ELISA setting (see FIG. 4A) as well as in a heterologous ELISA setting (see FIG. 4B). Of note, the observed heterologous humoral immune response (against another strain of genotype GII.4) is of particular importance for a broad protection against Norovirus infections, as GII.4 strains are fast-evolving which is challenging in successful Norovirus vaccine development.

FIG. 5 shows that the tested Norovirus mRNA vaccine induced Norovirus specific blocking antibody titers in immunized mice in a homologous and heterologous HGBA assay setup, showing that also functional antibodies were induced after immunization of mice with the inventive Norovirus mRNA vaccine. Of note, the induction of functional blocking antibodies also against another strain of genotype GII.4 demonstrates that the used mRNA Norovirus vaccine may also confer broad protection against different Norovirus strains of genotype GII.4.

FIG. 6 shows that the tested Norovirus mRNA vaccine stimulated a robust CD8+ IFN-γ/TNF-α and CD8+CD107a/IFN-γ in spleen of immunized mice.

Overall, the results of the immunization experiments in mice show that the inventive Norovirus mRNA vaccine induced a broad immune response engaging both the humoral-secretory and cellular immunity effector arms. Notably, heterologous immune responses were also observed (ELISA, HGBA). The data suggests that analogous mRNA constructs encoding other Norovirus antigens (as defined in the specifications or listed in Table 1 or Table 3) may also induce board immune responses in a similar manner.

Example 5: Immunization of Mice and Further Evaluation of Heterologous Immune Responses Female BALB/c mice are immunized intradermally (i.d.) and intramuscularily (i.m.) with protamine formulated or LNP formulated mRNA vaccines with doses, application routes and vaccination schedules as indicated in Table 6. As a negative control, one group of mice was injected with buffer (ringer lactate). All animals were vaccinated on day 0, 21 and 35. Blood samples are collected on day 49 for the determination of binding antibody titers (using a homologous and heterologous ELISA assay), blocking antibody titers (using a homologous and heterologous HGBA assay). Detailed descriptions of the performed experiments are provided below.

TABLE 6

Vaccination regimen of mice (Example 5)

| Group | No. of mice | Treatment | Dose | Route/Volume | Vaccination schedule |
|---|---|---|---|---|---|
| 1 | 6 | Norovirus GC-optimized VP1 GII.4-USA-1997 SEQ ID NO: 39738; R28 Protamine formulated | 80 μg | i.d. 2 × 50 μl | d 0, d 21, d 35 |
| 2 | 6 | Norovirus GC-optimized VP1 GII.4-2006b 092895-USA-2008 SEQ ID NO: 39729; R26 Protamine formulated | 80 μg | i.d. 2 × 50 μl | d 0, d 21, d 35 |
| 3 | 6 | Norovirus GC-optimized VP1 GII.4-GZ2010-L87-Guangzhou-2011 SEQ ID NO: 39734; R27 Protamine formulated | 80 μg | i.d. 2 × 50 μl | d 0, d 21, d 35 |
| 4 | 6 | Norovirus GC-optimized VP1_X124V SEQ ID NO: 39716; R4 Protamine formulated | 80 μg | i.d. 2 × 50 μl | d 0, d 21, d 35 |
| 5 | 6 | Norovirus GC-optimized VP1 GII.4-USA-1997 SEQ ID NO: 39738; R28 LNP formulated | 20 μg | i.m. 2 × 25 μl | d 0, d 21, d 35 |
| 6 | 6 | Norovirus GC-optimized VP1 GII.4-2006b 092895-USA-2008 SEQ ID NO: 39729; R26 LNP formulated | 20 μg | i.m. 2 × 25 μl | d 0, d 21, d 35 |
| 7 | 6 | Norovirus GC-optimized VP1 GII.4-GZ2010-L87-Guangzhou-2011 SEQ ID NO: 39734; R27 LNP formulated | 20 μg | i.m. 2 × 25 μl | d 0, d 21, d 35 |

TABLE 6-continued

| Vaccination regimen of mice (Example 5) | | | | | |
|---|---|---|---|---|---|
| Group | No. of mice | Treatment | Dose | Route/Volume | Vaccination schedule |
| 8 | 6 | Norovirus GC-optimized VP1_X124V SEQ ID NO: 39716; R4 LNP formulated | 20 µg | i.m. 2 × 25 µl | d 0, d 21, d 35 |
| 9 | 6 | 100% RiLa Control | | i.m. 1 × 25 µl | d 0, d 21, d 35 |

5.1. Determination of Homologous and Heterologous Immune Responses by ELISA:

ELISA is performed essentially as described in Example 4.1. Plates are coated with VLP 011.4 CIN1 and VLP GII.4 2011 to determine homologous and heterologous immune responses.

5.2. Determination of Blocking Antibody Titers Using a Heterologous HBGA Blocking Assay:

The HGBA assay is performed essentially as described in Example 4.2. The respective blocking index are calculated as commonly known in the art to evaluate homologous and heterologous cross neutralizing capacities of the used mRNA vaccines.

5.3. Determination of Specific CD8 T-Cell Responses Using ICS:

Multifunctional CD8 T-cell responses are analyzed as described in Example 4.3.

Example 6: Norovirus mRNA Vaccine Challenge Study in Gnotobiotic Pigs 6.1 Immunization of Gnotobiotic Pigs:

Gnotobiotic pigs are derived by hysterectomy from near-term sows and maintained in germ-free isolator units. Pigs are fed commercial ultra-high-temperature-treated sterile food. All pigs are confirmed as seronegative for Norovirus and germ-free prior to immunization experiments. Gnotobiotic pigs are immunized with protamine formulated or LNP formulated mRNA vaccines (monovalent, bivalent, or tetravalent) with doses, application routes and vaccination schedules as indicated in Table 7. Analysis of immune responses is performed essentially as described in Example 4 (ELISA, HGBA, and ICS).

TABLE 7

| Vaccination regimen of pigs (Example B) | | | | |
|---|---|---|---|---|
| Group | No. of pigs | Treatment | Dose/Route | Vaccination schedule |
| 1 | 6 | Monovalent vaccine: protamine formulated GII.4-2006b 092895-USA-2008 SEQ ID NO: 39729; R26 | 240 µg i.d. 2 × 200 µl | d 0, d 21 |
| 2 | 6 | Bivalent vaccine: protamine formulated GI.1-USA-1968-Capsidprotein SEQ ID NO: 39725; R29 + GII.4-GZ2010-L87-Guangzhou-2011 SEQ ID NO: 39734; R27 | 240 µg (total) i.d. 2 × 200 µl | d 0, d 21 |
| 3 | 6 | Tetravalent vaccine; protamine formulated GII.4-USA-1997 SEQ ID NO: 39738; R28 + GII.4-031693-USA-2003 SEQ ID NO: 39716; R4 + GII.4-2006b 092895-USA-2008 SEQ ID NO: 39729: R26 + GII.4-GZ2010-L87-Guangzhou-2011 SEQ ID NO: 39734; R27 | 240 µg (total) i.d. 2 × 200 µl | d 0, d 21 |
| 4 | 6 | Monovalent vaccine: LNP formulated GII.4-2006b 092895-USA-2008 SEQ ID NO: 39729; R26 | 60 µg i.m. 2 × 100 µl | d 0, d 21 |
| 5 | 6 | Bivalent vaccine: LNP formulated GI.1-USA-1968-Capsidprotein SEQ ID NO: 39725; R29 + GII.4-GZ2010-L87-Guangzhou-2011 SEQ ID NO: 39734; R27 | 60 µg (total) i.m. 2 × 100 µl | d 0, d 21 |
| 6 | 6 | Tetravalent vaccine: LNP formulated GII.4-USA-1997 SEQ ID NO: 39738; R28 + GII.4-031693-USA-2003 SEQ ID NO: 39716; R4 + GII.4-2006b 092895-USA-2008 SEQ ID NO: 39729; R26 + GII.4-GZ2010-L87-Guangzhou-2011 SEQ ID NO: 39734; R27 | 60 µg (total) i.m. 2 × 100 µl | d 0, d 21 |
| 7 | 6 | 100% RiLa Control | — | d 0, d 21 |

6.2. Norovirus Challenge Experiment:

At day 3D days post immunization, the vaccinated and buffer-injected control pigs are challenged orally with Norovirus GII.4 (isolated from human stool samples) to assess the protection against Norovirus-induced diarrhea and fecal virus shedding. After virus challenge, rectal swaps and feces samples are collected at day 1, 3, 5, 7 and 10. Norovirus loads in rectal swaps and feces samples are determined using quantitative PER. In addition, pigs are monitored for Norovirus-associated symptoms and fecal consistence scores are recorded to assess severity of the Norovirus infection.

Example 7: Immunization of Non-Human Primates and Evaluation of Immune Responses Non-human primates (NHPs) are immunized with protamine or LNP formulated mRNA vaccines with doses, application routes and vaccination schedules as indicated in Table 8. Analysis of immune responses is performed essentially as described in Example 4 (ELISA, HGBA, and ICS).

TABLE 8

Vaccination regimen of NHPs (Example 7)

| Group | Number of NHPs | Treatment | Dose/Route | Vaccination schedule |
|---|---|---|---|---|
| 1 | 6 | Monovalent vaccine protamine formulated GII.4-2006b 092895-USA-2008 SEQ ID NO: 39729; R26 | 240 μg i.d. 2 × 200 μl | d 0, d 21 |
| 2 | 6 | Bivalent vaccine: protamine formulated GI.1-USA-1968-Capsidprotein SEQ ID NO: 39725; R29 + GII.4-GZ2010-L87-Guangzhou-2011 SEQ ID NO: 39734; R27 | 240 μg (total) i.d. 2 × 200 μl | d 0, d 21 |
| 3 | 6 | Tetravalent vaccine: protamine formulated GII.4-USA-1997 SEQ ID NO: 39738; R28 + GII.4-031693-USA-2003 SEQ ID NO: 39716; R4 + GII.4-2006b 092895-USA-2008 SEQ ID NO: 39729; R26 + GII.4-GZ2010-L87-Guangzhou-2011 SEQ ID NO: 39734; R27 | 240 μg (total) i.d. 2 × 200 μl | d 0, d 21 |
| 4 | 6 | Monovalent vaccine: LNP formulated GII.4-2006b 092895-USA-2008 SEQ ID NO: 39729: R26 | 60 μg i.m. 2 × 100 μl | d 0, d 21 |
| 5 | 6 | Bivalent vaccine: LNP formulated GI.1-USA-1968-Capsidprotein SEQ ID NO: 39725; R29 + GII.4-GZ2010-L87-Guangzhou-2011 SEQ ID NO: 39734; R27 | 60 μg (total) i.m. 2 × 100 μl | d 0, d 21 |
| 6 | 6 | Tetravalent vaccine: LNP formulated GII.4-USA-1997 SEQ ID NO: 39738; R28 + GII.4-031693-USA-2003 SEQ ID NO: 39716; R4 + GII.4-2006b 092895-USA-2008 SEQ ID NO: 39729; R26 + GII.4-GZ2010-L87-Guangzhou-2011 SEQ ID NO: 39734; R27 | 60 μg (total) i.m. 2 × 100 μl | d 0, d 21 |
| 7 | 6 | 100% RiLa Control | i.m. 1 × 100 μl | d 0, d 21 |

Example 8: Development of a Multivalent Norovirus mRNA Vaccine 8.1. Generation of Bivalent, Tetravalent and Multivalent Norovirus mRNA Vaccines For bivalent and tetravalent Norovirus mRNA vaccines, each mRNA construct is individually produced (as described in Example 1).

Multivalent Norovirus vaccine compositions are produced according to procedures as disclosed in the PCT application PCT/EP2016/082487. In short, Norovirus DNA constructs (each of which comprising different norovirus coding sequences and a T7 promotor; e.g. synthetic DNA templates immobilized on a chip) are used as a matrix for simultaneous PER amplification. The obtained PER product mixture is purified and used as a template for simultaneous RNA in vitro transcription to generate a mixture of Norovirus mRNA constructs. The obtained Norovirus mRNA mixture is subjected to quantitative and qualitative measurements (e.g., RNA AGE, RT-qPCR, NGS, and Spectrometry). Following that, purification and formulation is performed (protamine formulation and LNP formulation). For the preparation of multivalent mRNA mixtures, Norovirus sequences as provided in Table 3 (see specifications) are used.

The produced bivalent, tetravalent and multivalent Norovirus mRNA vaccines are used for in vitro and in vivo experiments.

8.2. Expression Analysis of Multivalent Norovirus mRNA Vaccines Using Quantitative Mass Spectrometry Hela cells are transfected with bivalent, tetravalent and multivalent mRNA mixtures (see Table 9) and protein expression is analyzed using quantitative mass spectrometry to show that every mRNA comprised in the respective mRNA mixture is efficiently translated into Norovirus protein/antigen.

8.3. Immunization of Mice and Evaluation of Norovirus Specific Immune Responses

Female BALB/c mice are with protamine or LNP formulated monovalent, bivalent, tetravalent or multivalent mRNA vaccines with doses, application routes and vaccination schedules as indicated in Table 9. As a negative control, one group of mice is injected with buffer (ringer lactate, Rile). All animals are vaccinated on day 0, 21 and 35. Blood samples are collected on day 49 for the III determination of binding antibody titers (using an ELISA assay), blocking antibody titers (using a HGBA assay) and cellular immune responses (ICS) performed essentially as described in Example 4.

TABLE 9

Vaccination regimen of mice (Example 8)

| Group | Number of mice | Treatment | Dose/Route | Vaccination schedule |
|---|---|---|---|---|
| 1 | 6 | Monovalent vaccine: Protamine formulated GII.4-D31693-USA-2003 SEQ ID NO: 39716; R4 | 40 µg i.d. | d 0, d 21, d 35 |
| 2 | 6 | Bivalent vaccine: Protamine formulated R4 or R26 or R27 or R28 + R4 or R26 or R27 or R28 | 80 µg (40 µg each) i.d. | d 0, d 21, d 35 |
| 3 | 6 | Tetravalent vaccine; Protamine formulated GII.4-USA-1997 SEQ ID NO: 39738; R28 + GII.4-031693-USA-2003 SEQ ID NO: 397I6; R4 + GII.4-2006b 092895-USA-2008 SEQ ID NO: 39729; R26 + GII.4-GZ2010-L87-Guangzhou-2011 SEQ ID NO: 39734; R27 | 80 µg (20 µg each) i.d. | d 0, d 21, d 35 |
| 4 | 6 | Bivalent vaccine; Protamine formulated GI.1-USA-1968-Capsidprotein SEQ ID NO: 39725; R29 + R4 or R26 or R27 or R28 | 80 µg (40 µg each) i.d. | d 0, d 21, d 35 |
| 5 | 6 | Tetravalent vaccine: Protamine formulated GI.1-USA-1968-Capsidprotein SEQ ID NO: 39725; R29 + GII.4-USA-1997 SEQ ID NO: 39738; R28 + GII.4-031693-USA-2003 SEQ ID NO: 39716; R4 + GII.4-2006b 092895-USA-2008 SEQ ID NO: 39729; R26 | 80 µg (20 µg each) i.d. | d 0, d 21, d 35 |
| 6 | 6 | Multivalent: Protamine formulated. 20 constructs encoding Norovirus antigens of several genogroups, genotypes and strains (selected from Table 3). | 80 µg (total) i.d. | d 0, d 21, d 35 |
| 7 | 6 | Multivalent: Protamine formulated. 50 constructs encoding Norovirus antigens of several genogroups, genotypes and strains (selected from Table 3). | 80 µg (total) i.d. | d 0, d 21, d 35 |
| 8 | 6 | Multivalent: LNP formulated. 20 constructs encoding Norovirus antigens of several genogroups. genotypes and strains (selected from Table 3). | 80 µg (total) i.m. | d 0, d 21, d 35 |
| 9 | 6 | Multivalent: LNP formulated. 50 constructs encoding Norovirus antigens of several genogroups, genotypes and strains (selected from Table 3). | 80 µg (total) i.m. | d 0, d 21, d 35 |
| 10 | 6 | 100% RiLa Control | — | d 0, d 21, d 35 |

Example 9: Expression of Norovirus Proteins in HeLa Cells and Analysis by FACS To determine in vitro protein expression of the constructs, HeLa cells are transiently transfected with mRNA encoding Norovirus antigens and stained using suitable customized anti Norovirus-protein antibodies (raised in mouse) and a FITC-coupled secondary antibody (F5262 from Sigma).

Hela cells are seeded in a 6-well plate at a density of 400000 cells/well in cell culture medium (RPMI, 10% FCS, 1% L-Glutamine, 1% Pen/Strep), 24 h prior to transfection. Hela cells are transfected with 1 and 2 µg unformulated mRNA using Lipofectamine 2000 (Invitrogen). The mRNA constructs are used in the experiment, including a negative control encoding an irrelevant protein. 24 hours post transfection. Hela cells are stained with suitable anti Norovirus-protein antibodies (raised in mouse; 1:500) and anti-mouse FITC labelled secondary antibody (1:500) and subsequently analyzed by flow cytometry (FACS) on a BD FACS Canto II using the FACS Diva software. Quantitative analysis of the fluorescent FITC signal is performed using the FlowJo software package (Tree Star, Inc.).

Example 10: Expression and Secretion of Norovirus Proteins Using Western Blot For the analysis of Norovirus protein secretion, Hela cells are transfected with 1 µg and 2 µg unformulated mRNA (R1-R29, see Table 4) including a negative control encoding an irrelevant protein using Lipofectamine as the transfection agent. Supernatants, harvested 24 hours post transfection, are filtered through a 0.2 µm filter. Clarified supernatants are applied on top of 1 ml 20% sucrose cushion (in PBS) and centrifuged at 14000 rcf (relative centrifugal force) for 2 hours at 4° C. Horn virus protein content is analyzed by Western Blot suitable customized anti Norovirus-protein antibodies (raised in mouse; 1:500 diluted) as primary antibody in combination with secondary anti mouse antibody coupled to IRDye 800CW (Licor Biosciences). The presence of αβ-tubulin is also analyzed as control for cellular contamination (αβ-tubulin: Cell Signalling Technology; 1:1000 diluted) in combination with secondary anti rabbit antibody coupled to IRDye 680RD (Licor Biosciences).

For the analysis of Norovirus proteins in cell lysates, Hale cells are transfected with 1 μg and 2 μg unformulated mRNAs (R1-R29, see Table 4) including a negative control encoding an irrelevant protein using Lipofectamine as the transfection agent 24 hours post transfection, Held cells are detached by trypsin-free/EDTA buffer, harvested, and cell lysates are prepared. Cell lysates are subjected to SOS-PAGE under non-denaturating/non-reducing followed by western blot detection. Western Blot analysis is performed using a suitable customized anti Norovirus-protein antibodies antibody (raised in mouse; 1:500 diluted) as primary antibody in combination with secondary anti mouse antibody coupled to IRDye 800CW (Licor Biosciences).

Example 11: Preparation of Norovirus Vaccine Compositions

For in vivo vaccination experiments, different compositions of Norovirus mRNA vaccine are prepared using Norovirus mRNA constructs (see Table 4). One composition comprises protamine-complexed mRNA, one composition comprises mRNA that is formulated with an aluminum phosphate adjuvant.

11.1. Preparation of Protamine Complexed mRNA ("Vaccine Composition 1"; RNActive®):

Norovirus mRNA constructs are complexed with protamine prior to use in in vivo vaccination experiments. The mRNA complexation consists of a mixture of 50% free mRNA and 50% mRNA complexed with protamine at a weight ratio of 2:1. First, mRNA is complexed with protamine by addition of protamine-Ringer's lactate solution to mRNA. After incubation for 10 minutes, when the complexes are stably generated, free mRNA is added, and the final concentration of the vaccine is adjusted with Ringer's lactate solution.

11.2. Preparation of mRNA with Alum Phosphate ("Vaccine Composition 2"):

mRNA constructs are mixed with the desired amount of aluminum phosphate adjuvant in Ringer's lactate solution ("naked mRNA").

Example 12: Vaccination of Mice and Evaluation of Norovirus Specific Immune Response 12.1. Immunization Female BALB/c mice are injected intradermally (i.d.) and intramuscularly (i.m.) with respective mRNA vaccine compositions (prepared according to Example 11) with doses, application routes and vaccination schedules as indicated in Table 10. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

TABLE 10

| Vaccination regimen (Example 12) | | | | |
|---|---|---|---|---|
| Group | Number of mice | Vaccine composition | Route/ Volume | Vaccination Schedule (day) |
| 1 | 10 | 80 μg Norovirus RNActive ® Composition 1 | i.d. 2 × 50 μl | 0/21/35 |

TABLE 10-continued

| Vaccination regimen (Example 12) | | | | |
|---|---|---|---|---|
| Group | Number of mice | Vaccine composition | Route/ Volume | Vaccination Schedule (day) |
| 2 | 10 | 40 μg Norovirus RNActive ® Composition 1 | i.d. 2 × 50 μl | 0/21/35 |
| 3 | 10 | 20 μg Norovirus RNActive ® Composition 1 | i.d. 2 × 50 μl | 0/21/35 |
| 4 | 10 | 40 μg Norovirus naked RNA Composition 2 | i.m. 2 × 25 μl | 0/21/35 |
| 5 | 10 | 40 μg Norovirus naked RNA Composition 2 | i.m. 2 × 25 μl | 0/21/35 |
| 6 | 10 | 40 μg Norovirus naked RNA Composition 2 | i.m. 2 × 25 μl | 0/21/35 |
| 7 | 10 | 100% RiLa Control | i.d. 2 × 50 μl | 0/21/35 |

12.2. Determination of Anti-Norovirus Protein Antibodies by ELISA:

ELISA is performed using inactivated Norovirus infected cell lysate for coating. Coated plates are incubated using respective serum dilutions, and binding of specific antibodies to the Norovirus antigens are detected using biotinylated isotype specific anti-mouse antibodies followed by streptavidin-HRP (horse radish peroxidase) with ABTS as substrate. Endpoint titers of antibodies directed against the Norovirus antigens are measured by ELISA on day 63 after three vaccinations.

12.3. Intracellular Cytokine Staining

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2 \times 10^6$ cells per well). The cells are stimulated with a mixture of four Norovirus protein specific peptide epitopes (5 μg/ml of each peptide) in the presence of 2.5 μg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

12.4. Norovirus Plaque Reduction Neutralization Test (PRNT50)

Sera are analyzed by a plaque reduction neutralization test (PRNT50), performed as commonly known in the art. Briefly, obtained serum samples of vaccinated mice are incubated with Norovirus. That mixture is used to infect cultured cells, and the reduction in the number of plaques is determined.

Example 13: Clinical Development of a Norovirus mRNA Vaccine Composition

To demonstrate safety and efficiency of the NoraviromRNA vaccine composition, a randomized, double blind, placebo-controlled clinical trial (phase I) is initiated.

For clinical development, GMP-grade RNA is produced using an established GMP process, implementing various quality controls on DNA level and RNA level as described in detail in WO 2016/180430A1.

In the clinical trial, a cohort of human volunteers is intradermally or intramuscularly injected for at least two times with a monovalent, or a bivalent, or a tetravalent or a multivalent mRNA based Norovirus vaccine as specified herein.

In order to assess the safety profile of the Norovirus vaccine compositions according to the invention, subjects are monitored after administration (vital signs, vaccination site tolerability assessments, hematologic analysis).

The efficacy of the immunization is analysed by determination of virus neutralizing titers (VNT) or HBGA blocking titers in sera from vaccinated subjects. Blood samples are collected on day 0 as baseline and after completed vaccination. Sera are analyzed for virus neutralizing antibodies or HBGA blocking antibodies.

Furthermore, a subset of subjects is challenged with live GI.1 Norwalk virus or placebo by oral administration. Subjects are followed post-challenge for symptoms of Norovirus associated illness, infection and immune responses. There are multiple clinical assessments and collection of blood, emesis, saliva, and stool specimens.

Lengthy table referenced here

US11141474-20211012-T00001

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11141474B2). An electronic copy of the table will also be available from the USPTO upon request and payment of the fee set forth in 37 CFR 1.19(b)(3).

SEQUENCE LISTING (39746 sequences)

SEQ ID NO: 1 - protein, 540 aa, Artificial Sequence
  capsid_protein_VP1__Norovirus__ABY65350
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQSSTDTENDFETHQNTKFTPVGVIQDGSTTHRNEPQQWVLPSYSGRNVHNVHLAPAVAPTFPGEQLLFFRSTVPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2 - protein, 540 aa, Artificial Sequence
  capsid_protein_VP1__Norovirus__ACO55068
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPAEEIPAPLGTPDFVGRIQGVLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 3 - protein, 540 aa, Artificial Sequence
  capsid_protein_VP1__Norovirus__ADI45808
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPRIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLIPQDWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 4 - protein, 540 aa, Artificial Sequence
  capsid_protein_VP1__Norovirus__ADI45811
MKMASSDANPSDGSTANLVPEVNNEVMALEPVVGAAIAAPVAGQQNVIDPWIRNNFVQAPGGEFTVSPRNAPGEIPWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 5 - protein, 540 aa, Artificial Sequence
  capsid_protein_VP1__Norovirus__ADI45812
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFTPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 6 - protein, 540 aa, Artificial Sequence
  capsid_protein_VP1__Norovirus__ADI45814
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 7 - protein, 540 aa, Artificial Sequence
  capsid_protein_VP1__Norovirus__ADI45815
MKMASSDANPFDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 8 - protein, 540 aa, Artificial Sequence
  capsid_protein_VP1__Norovirus__ADI45816
MKMASNDANPSDGSAANLVPEINNEVMALEPVVGAAIAAPVAGQQNVIDPWIRNNFVQAPGGEFTVSPRNAPGEILWSAPLGPDLNPYLSHLARMYNGYAGGFEVQVIPAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 9 - protein, 540 aa, Artificial Sequence
  capsid_protein_VP1__Norovirus__ADI45817
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFPVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAV

SEQ ID NO: 10 - protein, 540 aa, Artificial Sequence
  capsid_protein_VP1__Norovirus__ADI45818
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRRAL

SEQ ID NO: 11 - protein, 541 aa, Artificial Sequence
  capsid_protein_VP1__Norovirus__AET79296
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKAGDKLKVTTFEMILGPTTNVDQAPYQGRVHASTSVTASLNLVDGRVRAVPRSIYSFQDVVPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLTFPTDGFFEVVSWVPRLYQLASVGSLATGRTLKQ

SEQ ID NO: 12 - protein, 541 aa, Artificial Sequence
  capsid_protein_VP1__Norovirus__AFB18026
MRMSDGATPKPNGSEAAGQDLVPSSVEQAIPIQPVAGAAVAAPTAGQINQIDPWIFQNFVQCPLGEFSISPRNTPGEILFDLALGPGLNPYLAHLSAMYTGWVGNMEVQLVLAGNAFTAGKVVVALVPPYFPQGSLTTAQITCFPHVMCDVRTLEPIQLPLLDVRRVLWHATQNQEEAMRLVCMLYTPLRTNSPGDESFVVSGRLLSRPSPDFNFVYLTPPIERTIYRMVDLPVVQPRLCTHSRWPAPVYQILVDPSLPSNPQWQNGRVLIDGTLLGTTPISSSWVASFAGTAEYSFQSPPSAEIGEVSLFEIDGSAYTPGDRAAPLGYPDFSGTLEVEIQTETTKAGQKLDVHTFNLELKSQTVDQAPFQGKVYMDLEASASLDLVNGRVRASPRSVAAFKDELPSYNSGLLVPLAPPLGPFLPGEVLLRFRTFARQVDTTDASAQAVDCALPQELVSWFASSNFTVQSEALLLRYRNTLTGQLLFECKLYSEGYIALSYTGSSPLTFPTDGFLEVVSWVPRLHQLASVGSLATGRSLKQ

SEQ ID NO: 13 - protein, 541 aa, Artificial Sequence
  capsid_protein_VP1__Norovirus__AFB18027
MRMSDGATPKPNGSEAAGQDLVPSSVEQAIPIQPVAGAAVAAPTAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEEAMRLVCMLYTPLRTNSPGDESFVVSGRLLSRPASDFNFVYLTPPIERTIYRMVDLPVVQPRLCTHSRWPAPVYQILVDPSLPSNPQWQNGRVQVDGTLLGTTPVSGSWVASFAGTAEYSFQTPPSAEIGTISLFEIDGSAYVPGDRAAPLGYPDSAGTLEVEIQTETTKAGQKLNVHTFSLELVSQTVDQAPYQGQIFVDLETSSSMDLVNGRVRASPRSISGFKDELPSYNNGLLVPLAPPLGPFLPGEVLLRFRTFAGQVDLTDAAAQPVDCALPQEFVSWFASNNFTVQSEALLLRYRNTLTGQLLFECKLYSEGYIALSYTGSGPLTFPTDGFFEVVSWVPRLYQLASVGSLATGRSLKQ

SEQ ID NO: 14 - protein, 544 aa, Artificial Sequence
  capsid_protein_VP1__Norovirus__AFI08231
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDTDYNPNTSIICTLDWLSQTAGQSNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRLGIRRS

SEQ ID NO: 15 - protein, 540 aa, Artificial Sequence
  capsid_protein_VP1__Norovirus__AFI08240
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 16 - protein, 539 aa, Artificial Sequence
  capsid_protein_VP1__Norovirus__AFS33552
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRRAL

SEQ ID NO: 17 - protein, 535 aa, Artificial Sequence
  capsid_protein_VP1__Norovirus__AFS33555
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVIVQPQNGRSTLDGELLGTTQLVPSNICALRGRINAQVPDDHHQWNLQVTNTNGTPFDPTEDVPAPLGTPDFLANIYGVTSQRNPNNTCRAHDGVLATWSPKFTPKLGSVILGTWEESDLDLNQPTRFTPVGLFNTDHFDQWALPSYSGRLTLNMNLAPSVSPLFPGEQLLFFRSHIPLKGGTSDGAIDCLLPQEWIQHFYQESAPSPTDVALIRYTNPDTGRVLFEAKLHRQGFITVANSGSRPIVVPPNGYFRFDSWVNQFYSLAPMGTGNGRRRVQ

SEQ ID NO: 18 - protein, 540 aa, Artificial Sequence
  capsid_protein_VP1__Norovirus__AFW15938
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 19 - protein, 540 aa, Artificial Sequence
  capsid_protein_VP1__Norovirus__AFW15940
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESKTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 20 - protein, 540 aa, Artificial Sequence
  capsid_protein_VP1__Norovirus__AFW15941
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 21 - protein, 540 aa, Artificial Sequence
  capsid_protein_VP1__Norovirus__AFW15944
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWSSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 22 - protein, 540 aa, Artificial Sequence
  capsid_protein_VP1__Norovirus__AFW15947
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 23 - protein, 540 aa, Artificial Sequence
  capsid_protein_VP1__Norovirus__AFW15948
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 24 - protein, 540 aa, Artificial Sequence; identical to SEQ ID NO: 22
  capsid_protein_VP1__Norovirus__AFW15949

SEQ ID NO: 25 - protein, 540 aa, Artificial Sequence
  capsid_protein_VP1__Norovirus__AFW15950
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNVCTFRGDVTHISGSRNYTMNLASQNWTSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 26 - protein, 540 aa, Artificial Sequence
  capsid_protein_VP1__Norovirus__AFW15951
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHISGSRNYTMNLASQNWTSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 27 - protein, 550 aa, Artificial Sequence
  capsid_protein_VP1__Norovirus__AFX71665
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARNHPLHVQVKNLDGTQYDPTDDIPAVLGAIDFQGTVFGVASQRDVSGQQEQGHYATRAHEAHIDTTDPKYAPKLGTILIKSDSDDFNTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 28 - protein, 540 aa, Artificial Sequence
  capsid_protein_VP1__Norovirus__AFX71668
MKMASSDASPSDGSTANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGNTTPRNEPQQWVLPSYSGRNIQNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 29 - protein, 540 aa, Artificial Sequence; identical to SEQ ID NO: 15
  capsid_protein_VP1__Norovirus__AFX81121

SEQ ID NO: 30 - protein, 540 aa, Artificial Sequence; identical to SEQ ID NO: 15
  capsid_protein_VP1__Norovirus__AFX81127

SEQ ID NO: 31 - protein, 540 aa, Artificial Sequence; identical to SEQ ID NO: 15
  capsid_protein_VP1__Norovirus__AFX81130

SEQ ID NO: 32 - protein, 540 aa, Artificial Sequence; identical to SEQ ID NO: 15
  capsid_protein_VP1__Norovirus__AFX81136

SEQ ID NO: 33 - protein, 540 aa, Artificial Sequence; identical to SEQ ID NO: 15
  capsid_protein_VP1__Norovirus__AFX81139

SEQ ID NO: 34 - protein, 540 aa, Artificial Sequence; identical to SEQ ID NO: 15
  capsid_protein_VP1__Norovirus__AFX81142

SEQ ID NO: 35 - protein, 540 aa, Artificial Sequence; identical to SEQ ID NO: 15
  capsid_protein_VP1__Norovirus__AFX81145

SEQ ID NO: 36 - protein, 540 aa, Artificial Sequence; identical to SEQ ID NO: 15
  capsid_protein_VP1__Norovirus__AFX81148

SEQ ID NO: 37 - protein, 540 aa, Artificial Sequence; identical to SEQ ID NO: 15
  capsid_protein_VP1__Norovirus__AFX81154

SEQ ID NO: 38 - protein, 540 aa, Artificial Sequence; identical to SEQ ID NO: 15
  capsid_protein_VP1__Norovirus__AFX81157

SEQ ID NO: 39 - protein, 540 aa, Artificial Sequence; identical to SEQ ID NO: 15
  capsid_protein_VP1__Norovirus__AFX81163

SEQ ID NO: 40 - protein, 540 aa, Artificial Sequence
  capsid_protein_VP1__Norovirus__AFX81166
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 41 - protein, 540 aa, Artificial Sequence; identical to SEQ ID NO: 15
  capsid_protein_VP1__Norovirus__AFX81169

SEQ ID NO: 42 - protein, 540 aa, Artificial Sequence; identical to SEQ ID NO: 15
  capsid_protein_VP1__Norovirus__AFX81172

SEQ ID NO: 43 - protein, 540 aa, Artificial Sequence; identical to SEQ ID NO: 15
  capsid_protein_VP1__Norovirus__AFX81178

SEQ ID NO: 44 - protein, 540 aa, Artificial Sequence; identical to SEQ ID NO: 15
  capsid_protein_VP1__Norovirus__AFX81181

SEQ ID NO: 45 - protein, 540 aa, Artificial Sequence; identical to SEQ ID NO: 15
  capsid_protein_VP1__Norovirus__AFX81190

SEQ ID NO: 46 - protein, 540 aa, Artificial Sequence; identical to SEQ ID NO: 15
  capsid_protein_VP1__Norovirus__AFX81193

SEQ ID NO: 47 - protein, 540 aa, Artificial Sequence; identical to SEQ ID NO: 15
  capsid_protein_VP1__Norovirus__AFX81196

SEQ ID NO: 48 - protein, 540 aa, Artificial Sequence
  capsid_protein_VP1__Norovirus__AFX81199
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 49 - protein, 540 aa, Artificial Sequence; identical to SEQ ID NO: 15
  capsid_protein_VP1__Norovirus__AFX81202

SEQ ID NO: 50 - protein, 540 aa, Artificial Sequence
  capsid_protein_VP1__Norovirus__AFX81205
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWALPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 51 - protein, 540 aa, Artificial Sequence; identical to SEQ ID NO: 15
  capsid_protein_VP1__Norovirus__AFX81208

SEQ ID NO: 52 - protein, 540 aa, Artificial Sequence; identical to SEQ ID NO: 15
  capsid_protein_VP1__Norovirus__AFX81211

SEQ ID NO: 53 - protein, 540 aa, Artificial Sequence; identical to SEQ ID NO: 15
  capsid_protein_VP1__Norovirus__AFX81214

SEQ ID NO: 54 - protein, 540 aa, Artificial Sequence; identical to SEQ ID NO: 15
  capsid_protein_VP1__Norovirus__AFX81226

SEQ ID NO: 55 - protein, 540 aa, Artificial Sequence
  capsid_protein_VP1__Norovirus__AFX81229
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 56 - protein, 540 aa, Artificial Sequence; identical to SEQ ID NO: 15
  capsid_protein_VP1__Norovirus__AFX81232

SEQ ID NO: 57 - protein, 540 aa, Artificial Sequence; identical to SEQ ID NO: 15
  capsid_protein_VP1__Norovirus__AFX81238

SEQ ID NO: 58 - protein, 540 aa, Artificial Sequence
  capsid_protein_VP1__Norovirus__AFX81241
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 59 - protein, 540 aa, Artificial Sequence
  capsid_protein_VP1__Norovirus__AFX81247
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWDSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 60 - protein, 540 aa, Artificial Sequence
  capsid_protein_VP1__Norovirus__AFX81250
MKMASSDANPSNGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPSSHNYTMNLASQNWNSYDPTEEIPAPLGTPDFVGKIQGVLTQTTRTDGSTRGHKATVYTGSADFSPKLGRVQFATDTDNDFQTNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 61 - protein, 540 aa, Artificial Sequence; identical to SEQ ID NO: 58
  capsid_protein_VP1__Norovirus__AFX81253

SEQ ID NO: 62 - protein, 540 aa, Artificial Sequence
  capsid_protein_VP1__Norovirus__AFX81256
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 63 - protein, 540 aa, Artificial Sequence; identical to SEQ ID NO: 15
  capsid_protein_VP1__Norovirus__AFX81262

SEQ ID NO: 64 - protein, 540 aa, Artificial Sequence; identical to SEQ ID NO: 15
  capsid_protein_VP1__Norovirus__AFX81265

SEQ ID NO: 65 - protein, 540 aa, Artificial Sequence
  capsid_protein_VP1__Norovirus__AFX81268
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 66 - protein, 540 aa, Artificial Sequence; identical to SEQ ID NO: 15
  capsid_protein_VP1__Norovirus__AFX81271

SEQ ID NO: 67 - protein, 540 aa, Artificial Sequence
  capsid_protein_VP1__Norovirus__AFX81274
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVSICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 68 - protein, 540 aa, Artificial Sequence; identical to SEQ ID NO: 65
  capsid_protein_VP1__Norovirus__AFX81277

SEQ ID NO: 69 - protein, 540 aa, Artificial Sequence
  capsid_protein_VP1__Norovirus__AFX81283
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 70 - protein, 540 aa, Artificial Sequence; identical to SEQ ID NO: 15
  capsid_protein_VP1__Norovirus__AFX81289

SEQ ID NO: 71 - protein, 540 aa, Artificial Sequence; identical to SEQ ID NO: 15
  capsid_protein_VP1__Norovirus__AFX81292

SEQ ID NO: 72 - protein, 540 aa, Artificial Sequence; identical to SEQ ID NO: 15
  capsid_protein_VP1__Norovirus__AFX81295

SEQ ID NO: 73 - protein, 540 aa, Artificial Sequence; identical to SEQ ID NO: 15
  capsid_protein_VP1__Norovirus__AFX81298

SEQ ID NO: 74 - protein, 540 aa, Artificial Sequence
  capsid_protein_VP1__Norovirus__AFX81301
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 75 - protein, 540 aa, Artificial Sequence; identical to SEQ ID NO: 15
  capsid_protein_VP1__Norovirus__AFX81304

SEQ ID NO: 76 - protein, 540 aa, Artificial Sequence; identical to SEQ ID NO: 15
  capsid_protein_VP1__Norovirus__AFX81307

SEQ ID NO: 77 - protein, 540 aa, Artificial Sequence; identical to SEQ ID NO: 15
  capsid_protein_VP1__Norovirus__AFX81313

SEQ ID NO: 78 - protein, 540 aa, Artificial Sequence; identical to SEQ ID NO: 15
  capsid_protein_VP1__Norovirus__AFX81316

SEQ ID NO: 79 - protein, 540 aa, Artificial Sequence; identical to SEQ ID NO: 15
  capsid_protein_VP1__Norovirus__AFX81319

SEQ ID NO: 80 - protein, 540 aa, Artificial Sequence; identical to SEQ ID NO: 15
  capsid_protein_VP1__Norovirus__AFX81322

SEQ ID NO: 81 - protein, 540 aa, Artificial Sequence; identical to SEQ ID NO: 15
  capsid_protein_VP1__Norovirus__AFX81325

SEQ ID NO: 82 - protein, 540 aa, Artificial Sequence; identical to SEQ ID NO: 15
  capsid_protein_VP1__Norovirus__AGE89433

SEQ ID NO: 83 - protein, 540 aa, Artificial Sequence; identical to SEQ ID NO: 15
  capsid_protein_VP1__Norovirus__AGE89436

SEQ ID NO: 84 - protein, 540 aa, Artificial Sequence; identical to SEQ ID NO: 62
  capsid_protein_VP1__Norovirus__AGE89439

SEQ ID NO: 85 - protein, 540 aa, Artificial Sequence
  capsid_protein_VP1__Norovirus__AGE89442
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRDVHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 86 - protein, 540 aa, Artificial Sequence
  capsid_protein_VP1__Norovirus__AGE89445
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 87 - protein, 540 aa, Artificial Sequence; identical to SEQ ID NO: 62
  capsid_protein_VP1__Norovirus__AGE89448

SEQ ID NO: 88 - protein, 540 aa, Artificial Sequence; identical to SEQ ID NO: 15
  capsid_protein_VP1__Norovirus__AGE89451

SEQ ID NO: 89 - protein, 540 aa, Artificial Sequence
  capsid_protein_VP1__Norovirus__AGE89454
MKMASNDANPSDGSAANLVPEVSNEVMALEPVVGAAIAAPVAGQQNVIDPWIRNNFVQAPGGEFTVSPRNAPGEILWGAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHNGQHDLVIPPNGYFRFDSWVNQFYTLAPMGNGTGRRRAL

SEQ ID NO: 90 - protein, 540 aa, Artificial Sequence; identical to SEQ ID NO: 15
  capsid_protein_VP1__Norovirus__AGE89457

SEQ ID NO: 91 - protein, 540 aa, Artificial Sequence; identical to SEQ ID NO: 15
  capsid_protein_VP1__Norovirus__AGE89460

SEQ ID NO: 92 - protein, 540 aa, Artificial Sequence; identical to SEQ ID NO: 15
  capsid_protein_VP1__Norovirus__AGE89463

SEQ ID NO: 93 - protein, 540 aa, Artificial Sequence; identical to SEQ ID NO: 15
  capsid_protein_VP1__Norovirus__AGE89466

SEQ ID NO: 94 - protein, 540 aa, Artificial Sequence; identical to SEQ ID NO: 89
  capsid_protein_VP1__Norovirus__AGE89472

SEQ ID NO: 95 - protein, 540 aa, Artificial Sequence; identical to SEQ ID NO: 65
  capsid_protein_VP1__Norovirus__AGE89475

SEQ ID NO: 96 - protein, 540 aa, Artificial Sequence; identical to SEQ ID NO: 15
  capsid_protein_VP1__Norovirus__AGE89478

SEQ ID NO: 97 - protein, 540 aa, Artificial Sequence
  capsid_protein_VP1__Norovirus__AGE89481
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 98 - protein, 540 aa, Artificial Sequence; identical to SEQ ID NO: 15
  capsid_protein_VP1__Norovirus__AGE89490

SEQ ID NO: 99 - protein, 540 aa, Artificial Sequence; identical to SEQ ID NO: 15
  capsid_protein_VP1__Norovirus__AGE89493

SEQ ID NO: 100 - protein, 540 aa, Artificial Sequence
  capsid_protein_VP1__Norovirus__AGE89496
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 101 - protein, 540 aa, Artificial Sequence; identical to SEQ ID NO: 15
  capsid_protein_VP1__Norovirus__AGE89499

SEQ ID NO: 102 - protein, 540 aa, Artificial Sequence
  capsid_protein_VP1__Norovirus__AGE89502
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 103 - protein, 540 aa, Artificial Sequence; identical to SEQ ID NO: 15
  capsid_protein_VP1__Norovirus__AGE89505

SEQ ID NO: 104 - protein, 540 aa, Artificial Sequence
  capsid_protein_VP1__Norovirus__AGE89508
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 105 - protein, 540 aa, Artificial Sequence; identical to SEQ ID NO: 15
  capsid_protein_VP1__Norovirus__AGE89511

SEQ ID NO: 106 - protein, 540 aa, Artificial Sequence; identical to SEQ ID NO: 15
  capsid_protein_VP1__Norovirus__AGE89514

SEQ ID NO: 107 - protein, 540 aa, Artificial Sequence; identical to SEQ ID NO: 15
  capsid_protein_VP1__Norovirus__AGE89517

SEQ ID NO: 108 - protein, 540 aa, Artificial Sequence; identical to SEQ ID NO: 102
  capsid_protein_VP1__Norovirus__AGE89520

SEQ ID NO: 109 - protein, 540 aa, Artificial Sequence; identical to SEQ ID NO: 15
  capsid_protein_VP1__Norovirus__AGE89523

SEQ ID NO: 110 - protein, 540 aa, Artificial Sequence; identical to SEQ ID NO: 15
  capsid_protein_VP1__Norovirus__AGE89526

SEQ ID NO: 111 - protein, 540 aa, Artificial Sequence; identical to SEQ ID NO: 97
  capsid_protein_VP1__Norovirus__AGE89529

SEQ ID NO: 112 - protein, 540 aa, Artificial Sequence; identical to SEQ ID NO: 15
  capsid_protein_VP1__Norovirus__AGE89532

SEQ ID NO: 113 - protein, 540 aa, Artificial Sequence; identical to SEQ ID NO: 65
  capsid_protein_VP1__Norovirus__AGE89535

SEQ ID NO: 114 - protein, 540 aa, Artificial Sequence
  capsid_protein_VP1__Norovirus__AGE89538
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRRAL

SEQ ID NO: 115 - protein, 540 aa, Artificial Sequence; identical to SEQ ID NO: 15
  capsid_protein_VP1__Norovirus__AGE89541

SEQ ID NO: 116 - protein, 540 aa, Artificial Sequence; identical to SEQ ID NO: 15
  capsid_protein_VP1__Norovirus__AGE89544

SEQ ID NO: 117 - protein, 540 aa, Artificial Sequence; identical to SEQ ID NO: 69
  capsid_protein_VP1__Norovirus__AGE89547

SEQ ID NO: 118 - protein, 540 aa, Artificial Sequence; identical to SEQ ID NO: 48
  capsid_protein_VP1__Norovirus__AGE89550

SEQ ID NO: 119 - protein, 540 aa, Artificial Sequence
  capsid_protein_VP1__Norovirus__AGE89553
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 120 - protein, 540 aa, Artificial Sequence; identical to SEQ ID NO: 97
  capsid_protein_VP1__Norovirus__AGE89556

SEQ ID NO: 121 - protein, 540 aa, Artificial Sequence
  capsid_protein_VP1__Norovirus__AGE89559
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRDVHNVHLAPAVAPTFPGEQILFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 122 - protein, 540 aa, Artificial Sequence
  capsid_protein_VP1__Norovirus__AGE89562
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 123 - protein, 540 aa, Artificial Sequence
  capsid_protein_VP1__Norovirus__AGE89565
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 124 - protein, 540 aa, Artificial Sequence; identical to SEQ ID NO: 15
  capsid_protein_VP1__Norovirus__AGE89568

SEQ ID NO: 125 - protein, 540 aa, Artificial Sequence; identical to SEQ ID NO: 15
  capsid_protein_VP1__Norovirus__AGE89571

SEQ ID NO: 126 - protein, 540 aa, Artificial Sequence; identical to SEQ ID NO: 15
  capsid_protein_VP1__Norovirus__AGE89574

SEQ ID NO: 127 - protein, 540 aa, Artificial Sequence; identical to SEQ ID NO: 15
  capsid_protein_VP1__Norovirus__AGE89577

SEQ ID NO: 128 - protein, 540 aa, Artificial Sequence; identical to SEQ ID NO: 48
  capsid_protein_VP1__Norovirus__AGE89580

SEQ ID NO: 129 - protein, 540 aa, Artificial Sequence; identical to SEQ ID NO: 15
  capsid_protein_VP1__Norovirus__AGE89583

SEQ ID NO: 130 - protein, 540 aa, Artificial Sequence
  capsid_protein_VP1__Norovirus__AGE89586
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 131 - protein, 540 aa, Artificial Sequence; identical to SEQ ID NO: 15
  capsid_protein_VP1__Norovirus__AGE89589

SEQ ID NO: 132 - protein, 540 aa, Artificial Sequence; identical to SEQ ID NO: 15
  capsid_protein_VP1__Norovirus__AGE89592

SEQ ID NO: 133 - protein, 540 aa, Artificial Sequence; identical to SEQ ID NO: 62
  capsid_protein_VP1__Norovirus__AGE89595

SEQ ID NO: 134 - protein, 540 aa, Artificial Sequence
  capsid_protein_VP1__Norovirus__AGE89598
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 135 - protein, 540 aa, Artificial Sequence; identical to SEQ ID NO: 15
  capsid_protein_VP1__Norovirus__AGE89601

SEQ ID NO: 136 - protein, 540 aa, Artificial Sequence; identical to SEQ ID NO: 15
  capsid_protein_VP1__Norovirus__AGE89604

SEQ ID NO: 137 - protein, 540 aa, Artificial Sequence; identical to SEQ ID NO: 15
  capsid_protein_VP1__Norovirus__AGE89607

SEQ ID NO: 138 - protein, 540 aa, Artificial Sequence; identical to SEQ ID NO: 15
  capsid_protein_VP1__Norovirus__AGE89610

SEQ ID NO: 139 - protein, 540 aa, Artificial Sequence; identical to SEQ ID NO: 48
  capsid_protein_VP1__Norovirus__AGE89613

SEQ ID NO: 140 - protein, 540 aa, Artificial Sequence
  capsid_protein_VP1__Norovirus__AGE89616
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRDVHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 141 - protein, 540 aa, Artificial Sequence; identical to SEQ ID NO: 62
  capsid_protein_VP1__Norovirus__AGE89622

SEQ ID NO: 142 - protein, 540 aa, Artificial Sequence
  capsid_protein_VP1__Norovirus__AGE89625
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFEINQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 143 - protein, 540 aa, Artificial Sequence
  capsid_protein_VP1__Norovirus__AGE89628
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 144 - protein, 540 aa, Artificial Sequence; identical to SEQ ID NO: 15
  capsid_protein_VP1__Norovirus__AGE89631

SEQ ID NO: 145 - protein, 540 aa, Artificial Sequence; identical to SEQ ID NO: 69
  capsid_protein_VP1__Norovirus__AGE89634

SEQ ID NO: 146 - protein, 540 aa, Artificial Sequence; identical to SEQ ID NO: 15
  capsid_protein_VP1__Norovirus__AGE89637

SEQ ID NO: 147 - protein, 540 aa, Artificial Sequence; identical to SEQ ID NO: 15
  capsid_protein_VP1__Norovirus__AGE89640

SEQ ID NO: 148 - protein, 540 aa, Artificial Sequence
  capsid_protein_VP1__Norovirus__AGE89643
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWMLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 149 - protein, 540 aa, Artificial Sequence; identical to SEQ ID NO: 15
  capsid_protein_VP1__Norovirus__AGE89646

SEQ ID NO: 150 - protein, 540 aa, Artificial Sequence
  capsid_protein_VP1__Norovirus__AGE89649
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 151 - protein, 540 aa, Artificial Sequence
  capsid_protein_VP1__Norovirus__AGE89652
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLATQNWNSYDPTEEIPAPLGTPDFVGKIQGVLTQTTRADGSTRGHKATVYTGSADFAPKLGRVQFATDTNNDLGANQNTKFTPVGVIQDGGTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 152 - protein, 540 aa, Artificial Sequence; identical to SEQ ID NO: 15
  capsid_protein_VP1__Norovirus__AGE89655

SEQ ID NO: 153 - protein, 540 aa, Artificial Sequence; identical to SEQ ID NO: 15
  capsid_protein_VP1__Norovirus__AGE89658

SEQ ID NO: 154 - protein, 540 aa, Artificial Sequence; identical to SEQ ID NO: 15
  capsid_protein_VP1__Norovirus__AGE89661

SEQ ID NO: 155 - protein, 540 aa, Artificial Sequence
  capsid_protein_VP1__Norovirus__AGE89664
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTEDDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 156 - protein, 540 aa, Artificial Sequence; identical to SEQ ID NO: 15
  capsid_protein_VP1__Norovirus__AGE89667

SEQ ID NO: 157 - protein, 540 aa, Artificial Sequence; identical to SEQ ID NO: 15
  capsid_protein_VP1__Norovirus__AGE89673

SEQ ID NO: 158 - protein, 540 aa, Artificial Sequence
  capsid_protein_VP1__Norovirus__AGE99603
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQMILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTDNDFETHQNTRFTPVGVIQDGATTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 159 - protein, 540 aa, Artificial Sequence
  capsid_protein_VP1__Norovirus__AGI17592
MMMASNDAAPSNDGATGLVPEINHETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPANRMRLVAMLYTPLRSNGSGDDVFTVSCRVLTRPTPDFEFTYLVPPSVESKTKPFSLPILTISELTNSRFPAPIDSLYTAQNNNLNVQCQNGRCTLDGELQGTTQLLPSGICAFRGKLTADVHQSHDDRWHMQLTNLNGTPFDPTEDVPAPLGTPDFTGLLFGVASQRNVVSNPNTTRAHEAVISTTSSQFVPKLGSINFGSTSDDFQLQQPTKFTPVGIKVESGHDFDQWALPRYSGHLTLNMNLAPPVAPNFPGEQLLFFRSNVPCAGGVSDGVIDCLLPQEWIQYFYQESAPSQSDVALIRYVNPDTGRTLFEAKLHRTGYITVAHSGDYPLVVPSNGYFRFDSWVNQFYSLAPMGTGNGRRRVQ

SEQ ID NO: 160 - protein, 549 aa, Artificial Sequence
  capsid_protein_VP1__Norovirus__AGI17594
MKMASNDAAPSNDGAAGLVPEINSEAMALEPVAGAAIAAPLTGQQNIIDPWIMNNFVQAPGGEFTISPRNGPGEVLLNLELGPEINPYLAHLARMYNGYAGGFEVQVVLAGNAFTAGKIIFAAIPPNFPIDNLSAAQVTMCPHVIVDVRQLEPVNLPMPDVRNSFFHYNQGTDSRLRLIAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTQRTSRASDQADTAVTPRAFDHRWHIQLDNLNGTHYDPSEDIPGPLGIPDFRGRVYGVASQRNSDGSTRAHEAKIDTTSSRFTPKLGSLEISTESDDFDENKPTRFTPVGIGVDNEREFQQWSLPDYSGQFTHNMHLAPAVAPNFPGEQLLFFRSHLPSSGGWVDGTLDCLLPQEWIQHFYQESAPSQTQVALVRYVNPDTGRVLFEAKLHKSGFMTIARSGDSPITVPPNGYFRFESWVNPFYTLAPMGTGNGRRRIQ

SEQ ID NO: 161 - protein, 540 aa, Artificial Sequence
  capsid_protein_VP1__Norovirus__AGK36311
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 162 - protein, 540 aa, Artificial Sequence; identical to SEQ ID NO: 62
  capsid_protein_VP1__Norovirus__AGK36314

SEQ ID NO: 163 - protein, 530 aa, Artificial Sequence
  capsid_protein_VP1__Norovirus__AGM33208
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 164 - protein, 530 aa, Artificial Sequence
  capsid_protein_VP1__Norovirus__AGM33214
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVNTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 165 - protein, 530 aa, Artificial Sequence; identical to SEQ ID NO: 163
  capsid_protein_VP1__Norovirus__AGM33217

SEQ ID NO: 166 - protein, 530 aa, Artificial Sequence
  capsid_protein_VP1__Norovirus__AGM33220
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGVGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 167 - protein, 530 aa, Artificial Sequence
  capsid_protein_VP1__Norovirus__AGM33226
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDIFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 168 - protein, 530 aa, Artificial Sequence
  capsid_protein_VP1__Norovirus__AGM33229
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPVTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 169 - protein, 530 aa, Artificial Sequence
  capsid_protein_VP1__Norovirus__AGM33232
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSRPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 170 - protein, 530 aa, Artificial Sequence; identical to SEQ ID NO: 169
  capsid_protein_VP1__Norovirus__AGM33235

SEQ ID NO: 171 - protein, 530 aa, Artificial Sequence
  capsid_protein_VP1__Norovirus__AGM33238
MMMASKDATSSVDGASGAGQLVPEVNASDPLAMDPVAGSSTAVATTGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGIGSGNYVGVLSWISPPSHPSGSQVDLWKIPNYGSSITEATHLAPSVYPPGFGEVLVFFMSKMPGPGAYNLPCLLPQEYISHLASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 172 - protein, 530 aa, Artificial Sequence; identical to SEQ ID NO: 163
  capsid_protein_VP1__Norovirus__AGM33241

SEQ ID NO: 173 - protein, 530 aa, Artificial Sequence; identical to SEQ ID NO: 164
  capsid_protein_VP1__Norovirus__AGM33244

SEQ ID NO: 174 - protein, 541 aa, Artificial Sequence
  capsid_protein_VP1__Norovirus__AGO59890
MRMSDGAAPKANGSEASGQDLVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYKFQSGIGEVATFTLIEQDGSAYVPGDRAAPLGYPDFSGQLEIEVQTETTKTGDKLKVTTFEMILGPTTNADQAPYQGRVFASVTAAASLDLVDGRVRAVPRSIYGFQDTIPEYNDGLLVPLAPPIGPFLPGEVLLRFRTYMRQIDTADAAAEAIDCALPQEFVSWFASNAFTVQSEALLLRYRNTLTGQLLFECKLYNEGYIALSYSGSGPLTFPTDGIFEVVSWVPRLYQLASVGSLATGRMLKQ

SEQ ID NO: 175 - protein, 539 aa, Artificial Sequence
  capsid_protein_VP1__Norovirus__AGT17782
MKMASNDATPSDGSSANLVPEVNNEVMALEPVAGAAIAAPVAGQQNVIDPWIRNNFVQAPGGEFTVSPRNAPGEILWSASLGPDLNPYLSHLSRMYNGYAGSFEVQVILAGNAFTAGKIIFAAVPPNFRTEGLSPSQITMFPHIITDVRQLEPVLIPLPDIRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTRIGNSREYRMNLASLNWNNYDPTEEIPAPLGTPDFAGKIQGVLTQTTRHDGSTRGHKATVYTGSAGFTPKLGSVQFSTDTDNDLEANQNTRFTPVGVIQDGNAHQGEPQQWVLPNYAGRDGHNVHLAPAVAPTFPGEQLLFFRSTMPGCSGYPNMNLDCLLPQEWVQHFYQESAPAQSDVALLRFVNPDTGRVLFECKLHKSGYVTVAHTGPHDLVIPPNGYFRFDSWVNQFYTLAPMGNGAGRRRAL

SEQ ID NO: 176 - protein, 530 aa, Artificial Sequence; identical to SEQ ID NO: 163
  capsid_protein_VP1__Norovirus__AGT17785

SEQ ID NO: 177 - protein, 540 aa, Artificial Sequence
  capsid_protein_VP1__Norovirus__AGT17788
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAV

SEQ ID NO: 178 - protein, 530 aa, Artificial Sequence; identical to SEQ ID NO: 163
  capsid_protein_VP1__Norovirus__AGT17792

SEQ ID NO: 179 - protein, 540 aa, Artificial Sequence
  capsid_protein_VP1__Norovirus__AGT17795
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVINQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 180 - protein, 538 aa, Artificial Sequence
  capsid_protein_VP1__Norovirus__AGT17798
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEETPAPLGTPDFVGKIQGVLTQTTKGNGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRRAL

SEQ ID NO: 181 - protein, 530 aa, Artificial Sequence; identical to SEQ ID NO: 163
  capsid_protein_VP1__Norovirus__AGT17803

SEQ ID NO: 182 - protein, 530 aa, Artificial Sequence; identical to SEQ ID NO: 163
  capsid_protein_VP1__Norovirus__AGT17806

SEQ ID NO: 183 - protein, 530 aa, Artificial Sequence; identical to SEQ ID NO: 163
  capsid_protein_VP1__Norovirus__AGT17809

SEQ ID NO: 184 - protein, 540 aa, Artificial Sequence
  capsid_protein_VP1__Norovirus__AGT17813
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRRAL

SEQ ID NO: 185 - protein, 540 aa, Artificial Sequence
  capsid_protein_VP1__Norovirus__AGT17816
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWSNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 186 - protein, 540 aa, Artificial Sequence
  capsid_protein_VP1__Norovirus__AGT17819
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGGTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 187 - protein, 540 aa, Artificial Sequence
  capsid_protein_VP1__Norovirus__AGT17823
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPLLIPLPDVRNNFYHYNQSNDPTIKLIAMLYTPLRANNAGDDVFTVSCRVLTRPSPDFDFIFLVPPTVESRTKPFSVPILTIEEMTNSRFPIPLEKLFTGPSSAFVVQPQNGRCTTDGVLLGTTQLSPVNICTFRGDVTHITGTHNYAMNLAAQNWNSYDPTEEIPAPLGTPDFVGKIQGVLTQTTRADGSTRAHKATVYTGSAEFAPKLGRVQFATDTDSDFDTNQNTKFTPVGVIQDGNTAHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGQHDLVIPPNGYFRFDSWVSPFYTLAPMGNGTGRRRAL

SEQ ID NO: 188 - protein, 530 aa, Artificial Sequence; identical to SEQ ID NO: 163
  capsid_protein_VP1__Norovirus__AGT17826

SEQ ID NO: 189 - protein, 539 aa, Artificial Sequence
  capsid_protein_VP1__Norovirus__AGT17830
MKMASNDATPSDGSSANLVPEANNEVMALEPVAGAAIAAPVAGQQNVIDPWIRNNFVQAPGGEFTVSPRNAPGEILWSASLGPDLNPYLSHLSRMYNGYAGSFEVQVILAGNAFTAGKIIFAAVPPNFRTEGLSPSQITMFPHIITDVRQLEPVLIPLPDIRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTRIGNSREYRMNLASLNWNNYDPTEEIPAPLGTPDFAGKIQGVLTQTTRHDGSTRGHKATVYTGSAGFTPKLGSVQFSTDTDNDLEANQNTRFTPVGVIQDGNAHQGEPQQWVLPNYAGRDGHNVHLAPAVAPTFPGEQLLFFRSTMPGCSGYPNMNLDCLLPQEWVQHFYQESAPAQSDVALLRFVNPDTGRVLFECKLHKSGYVTVAHTGPHDLVIPPNGYFRFDSWVNQFYTLAPMGNGAGRRRAL

SEQ ID NO: 190 - protein, 540 aa, Artificial Sequence
  capsid_protein_VP1__Norovirus__AGT17833
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 191 - protein, 530 aa, Artificial Sequence; identical to SEQ ID NO: 163
  capsid_protein_VP1__Norovirus__AGT17836

SEQ ID NO: 192 - protein, 539 aa, Artificial Sequence
  capsid_protein_VP1__Norovirus__AGT17842
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPGQVTMFPHIIVDVRQLEPVLIPLPDVRNNFYHYNQSNDPTIKLVAMLYTPLRANNAGDDVFTVSCRVLTRPSPDFDFIFLVPPTIESKTKSFSVPILTIEEMTNSRFPIPLEKLFTGPSSTLVVQPQNGRCTTDGVLLGTTQLSPVNICTFRGDVTQITNTHSYEMNLAAQNWNSYDPTEEIPAPLGTPDFVGKIQGVLTQTTKENGSTRAHKATVYTGSTGFTPKLGRVQFVTDTDRDLETNQDTKFTPVGVIQDGDAHQNEPQQWVLPSYLGTNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGRHDLVIPPNGYFRFDSWVSPFYTLAPMGNGTGRRRAL

SEQ ID NO: 193 - protein, 540 aa, Artificial Sequence
  capsid_protein_VP1__Norovirus__AGU68328
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFAAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTLRGDVTHITGSRNYTMNLASQNWNNYDPTEEIPAPLGTPDFVGKIQGMLTQTTRTDGSTRGYKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 194 - protein, 539 aa, Artificial Sequence
  capsid_protein_VP1__Norovirus__AGX85889
MKMASSDANPSDGSTANLVPEANNEVMALEPVVGAAIAAPVAGQQNVIDPWIRNNFVQAPGGEFTVSPRNAPGEILWSAPLGPDLNPYLSHLSRMYNGYAGGFEVQVILAGNAFAAGKIIFAAVPPNFPTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGSAEFTPKLGRIQLFTDTDNDLEANQNTKFTPVGVIQDGDTHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRRAL

SEQ ID NO: 195 - protein, 539 aa, Artificial Sequence
  capsid_protein_VP1__Norovirus__AGX85892
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFPTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGGVEFTPKLGRIQLFTDTDNDLEANQNTKFTPVGVIQDGDTHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRRAL

SEQ ID NO: 196 - protein, 539 aa, Artificial Sequence
  capsid_protein_VP1__Norovirus__AGX85895
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFPTEGLSPSQVTMFPHLIIDVRQLEPVMIPLPDVRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHITKTHSYQMNLAAQNWNSYDPTEEIPAPLGTPDFVGKIQGVLTQTTKGNGSTRAHKATVYTGSTEFTPKLGRIQLVTDTDNDLETNQNTKFTPVGVIQDGDTHQNEPQQWVLPSYLGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLFIPPNGYFRFDSWVSPFYTLAPMGNGTGRRRAL

SEQ ID NO: 197 - protein, 540 aa, Artificial Sequence
  capsid_protein_VP1__Norovirus__AGX85904
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWSNYDPTEEIPAPLGTPDFVGKIQGVLTQTTKGDGSTRGHKATVYTGSADFTPKLGSIQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 198 - protein, 538 aa, Artificial Sequence
  capsid_protein_VP1__Norovirus__AGX85913
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKENGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRRAL

SEQ ID NO: 199 - protein, 540 aa, Artificial Sequence
  capsid_protein_VP1__Norovirus__AGX85916
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFDTNQNTKFTPVGVIQDGGTTHRNEPQQWVLPSYSGRNTHNVHLAPAVAPTFPGEQLLFFRSTMPGSSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 200 - protein, 538 aa, Artificial Sequence; identical to SEQ ID NO: 198
  capsid_protein_VP1__Norovirus__AGX85931

SEQ ID NO: 201 - protein, 538 aa, Artificial Sequence
  capsid_protein_VP1__Norovirus__AGX85934
MKMASSDANPSDGSTANLVPEANNEVMALEPVVGAAIAAPVAGQQNVIDPWIRNNFVQAPGGEFTVSPRNAPGEVLWSAPLGPDLNPYLSHLARMYNGYAGGFEVQVILAGNAFAAGKIIFAAVPPNFSTEGLSPSQVTMFPHLIVDVRQLEPVMIPLPDIRNNFYHYNQSNDPTIKLIAMLYTPLRANNVGDDVFTVSCRVLTRPSPDFDFIFLVPPTVESKTNPFSVPILTIEEMTNSRFPIPLEKLFTGPSSALVVQPQNGRCTTDGVLLGTTQLSPVNICTFRGDVTHTTKTHTYQMNLAAQNWNSYDPTEEIPAPLGTPDFVGKIQGVLTQTTKGNGSTRAHKATVYTGTVEFTPKLGRIQLFTDTDNDLEANQNTKFTPVGVIQDGDHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGHHDLVIPPNGYFRFDSWVSPFYTLAPMGNGTGRRRAL

SEQ ID NO: 202 - protein, 547 aa, Artificial Sequence
  capsid_protein_VP1__Norovirus__AHI59154
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSMVPSAGGYGSGQIDCLMPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 203 - protein, 540 aa, Artificial Sequence
  capsid_protein_VP1__Norovirus__AHI59157
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 204 - protein, 542 aa, Artificial Sequence
  capsid_protein_VP1__Norovirus__AHI59159
MKMASNDAAPSTDGAAGLVPESNSEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGVISQRDKHNSPGHNEPANRGHDAVVPTYTAQYTPKLGQVQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 205 - protein, 540 aa, Artificial Sequence
  capsid_protein_VP1__Norovirus__AHK24788
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTAAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKAGDKLKVTTFEMILGPTTNVDQAPYQGRVYASLTAAASLDLVDGRVRAVPRSIYGFQDQIPEYNDGLLVPLAPPVGPFLPGELLLRFRTYMRQIDSADAAAEAIDCALPQEFISWFASNAFTVQSEALLLRYRNTLTGQLLFECKLYSEGYIALSYSGSGPLTFPTDGFFEVVSWVPRLYQLASVGSLATGRTLK

SEQ ID NO: 206 - protein, 540 aa, Artificial Sequence
  capsid_protein_VP1__Norovirus__AHX22018
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSGAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 207 - protein, 540 aa, Artificial Sequence
  capsid_protein_VP1__Norovirus__AHX22021
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFTTDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 208 - protein, 540 aa, Artificial Sequence
  capsid_protein_VP1__Norovirus__AHX22025
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 209 - protein, 540 aa, Artificial Sequence
  capsid_protein_VP1__Norovirus__AHX22028
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 210 - protein, 540 aa, Artificial Sequence
  capsid_protein_VP1__Norovirus__AHX22032
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHQNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 211 - protein, 540 aa, Artificial Sequence
  capsid_protein_VP1__Norovirus__AHX22038
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASLNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 212 - protein, 540 aa, Artificial Sequence
  capsid_protein_VP1__Norovirus__AHX22041
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFATDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 213 - protein, 540 aa, Artificial Sequence
  capsid_protein_VP1__Norovirus__AHX22047
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 214 - protein, 540 aa, Artificial Sequence
  capsid_protein_VP1__Norovirus__AHX22050
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 215 - protein, 540 aa, Artificial Sequence
  capsid_protein_VP1__Norovirus__AHX22054
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 216 - protein, 548 aa, Artificial Sequence
  capsid_protein_VP1__Norovirus__AIA96988
MKMASNDAAPSNDGAAGLVPEISNEAMALDPVAGAAIAAPLTGQQNIIDPWIMNNFVQAPGGEFTVSPRNSPGEILLNLELGPEINPYLAHLARMYNGYAGGFEVQVVLAGNAFTAGKVIFAAIPPNFPTDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTRSTSRASDHADTATPRLFNYYWHIQLDNLNGTPYDPAEDIPAPLGTPDFRGKVFGVASQRNPDSTTRAHEAKVDTTSGRFTPKLGSLEMSTESDDFDQNQPTRFTPVGIGVDNEADFQQWTLPDYSGQFTHNMNLAPAVAPNFPGEQLLFFRSQLPSSGGRSNGILDCLVPQEWVQHFYQESAPAQTQVALVRYVNPDTGRVLFEAKLHKLGYMTIAKSGDSPITVPPNGYFRFESWVNPFYTLAPMGTGNGRRRIQ

SEQ ID NO: 217 - protein, 540 aa, Artificial Sequence
  capsid_protein_VP1__Norovirus__AII02569
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLYKSGYVTVAHTGQHDLVIPPNGYFRFDSWVNQFYTLAPMGNGTGRRRAL

SEQ ID NO: 218 - protein, 540 aa, Artificial Sequence; identical to SEQ ID NO: 15
  capsid_protein_VP1__Norovirus__AII02572

SEQ ID NO: 219 - protein, 540 aa, Artificial Sequence; identical to SEQ ID NO: 15
  capsid_protein_VP1__Norovirus__AII02575

SEQ ID NO: 220 - protein, 540 aa, Artificial Sequence; identical to SEQ ID NO: 58
  capsid_protein_VP1__Norovirus__AII02578

SEQ ID NO: 221 - protein, 548 aa, Artificial Sequence
  capsid_protein_VP1__Norovirus__AII02581
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVLLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQNQPTRFTPVGIGVDHEADFQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 222 - protein, 540 aa, Artificial Sequence
  capsid_protein_VP1__Norovirus__AII02584
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 223 - protein, 540 aa, Artificial Sequence; identical to SEQ ID NO: 15
  capsid_protein_VP1__Norovirus__AII02590

SEQ ID NO: 224 - protein, 540 aa, Artificial Sequence; identical to SEQ ID NO: 62
  capsid_protein_VP1__Norovirus__AII02593

SEQ ID NO: 225 - protein, 540 aa, Artificial Sequence; identical to SEQ ID NO: 15
  capsid_protein_VP1__Norovirus__AII02596

SEQ ID NO: 226 - protein, 540 aa, Artificial Sequence
  capsid_protein_VP1__Norovirus__AII02599
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDITHIAGSRDYTMNLASLNWNNYDPTEEIPAPLGTPDFVGKIQGVLTQTTKRDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 227 - protein, 540 aa, Artificial Sequence; identical to SEQ ID NO: 62
  capsid_protein_VP1__Norovirus__AII02602

SEQ ID NO: 228 - protein, 535 aa, Artificial Sequence
  capsid_protein_VP1__Norovirus__AII02605
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 229 - protein, 548 aa, Artificial Sequence
  capsid_protein_VP1__Norovirus__AII02608
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQNQPTRFTPVGIGVDHEADLQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 230 - protein, 540 aa, Artificial Sequence; identical to SEQ ID NO: 69
  capsid_protein_VP1__Norovirus__AII02614

SEQ ID NO: 231 - protein, 550 aa, Artificial Sequence
  capsid_protein_VP1__Norovirus__AII02623
MKMASNDATPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDFPQRARNHPLHVQVKNLDGTQYDPTDDIPAVLGAIDFKGTVFGVASQRDVSGTQEQGHYATRAHEAHIDTTDPKYAPKLGTILIKSESTDFNTNQPIRFTPVGMGDNNWRQWELPDYSGSLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 232 - protein, 540 aa, Artificial Sequence; identical to SEQ ID NO: 15
  capsid_protein_VP1__Norovirus__AII02626

SEQ ID NO: 233 - protein, 548 aa, Artificial Sequence
  capsid_protein_VP1__Norovirus__AII02629
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQNQPTRFTPVGIGVDHEADFQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 234 - protein, 540 aa, Artificial Sequence; identical to SEQ ID NO: 65
  capsid_protein_VP1__Norovirus__AII02632

SEQ ID NO: 235 - protein, 540 aa, Artificial Sequence; identical to SEQ ID NO: 15
  capsid_protein_VP1__Norovirus__AII02635

SEQ ID NO: 236 - protein, 535 aa, Artificial Sequence; identical to SEQ ID NO: 228
  capsid_protein_VP1__Norovirus__AII02638

SEQ ID NO: 237 - protein, 540 aa, Artificial Sequence; identical to SEQ ID NO: 15
  capsid_protein_VP1__Norovirus__AII02641

SEQ ID NO: 238 - protein, 548 aa, Artificial Sequence; identical to SEQ ID NO: 233
  capsid_protein_VP1__Norovirus__AII02644

SEQ ID NO: 239 - protein, 540 aa, Artificial Sequence; identical to SEQ ID NO: 50
  capsid_protein_VP1__Norovirus__AII02647

SEQ ID NO: 240 - protein, 540 aa, Artificial Sequence; identical to SEQ ID NO: 62
  capsid_protein_VP1__Norovirus__AII02650

SEQ ID NO: 241 - protein, 540 aa, Artificial Sequence
  capsid_protein_VP1__Norovirus__AII02653
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRRAL

SEQ ID NO: 242 - protein, 548 aa, Artificial Sequence; identical to SEQ ID NO: 233
  capsid_protein_VP1__Norovirus__AII02656

SEQ ID NO: 243 - protein, 540 aa, Artificial Sequence; identical to SEQ ID NO: 15
  capsid_protein_VP1__Norovirus__AII02659

SEQ ID NO: 244 - protein, 548 aa, Artificial Sequence; identical to SEQ ID NO: 233
  capsid_protein_VP1__Norovirus__AII02662

SEQ ID NO: 245 - protein, 540 aa, Artificial Sequence; identical to SEQ ID NO: 15
  capsid_protein_VP1__Norovirus__AII02665

SEQ ID NO: 246 - protein, 540 aa, Artificial Sequence; identical to SEQ ID NO: 15
  capsid_protein_VP1__Norovirus__AII02668

SEQ ID NO: 247 - protein, 540 aa, Artificial Sequence; identical to SEQ ID NO: 15
  capsid_protein_VP1__Norovirus__AII02671

SEQ ID NO: 248 - protein, 540 aa, Artificial Sequence
  capsid_protein_VP1__Norovirus__AII02674
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 249 - protein, 540 aa, Artificial Sequence; identical to SEQ ID NO: 58
  capsid_protein_VP1__Norovirus__AII02677

SEQ ID NO: 250 - protein, 540 aa, Artificial Sequence
  capsid_protein_VP1__Norovirus__AII02680
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQINDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDIHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 251 - protein, 540 aa, Artificial Sequence; identical to SEQ ID NO: 15
  capsid_protein_VP1__Norovirus__AII02683

SEQ ID NO: 252 - protein, 540 aa, Artificial Sequence; identical to SEQ ID NO: 15
  capsid_protein_VP1__Norovirus__AII02689

SEQ ID NO: 253 - protein, 540 aa, Artificial Sequence; identical to SEQ ID NO: 102
  capsid_protein_VP1__Norovirus__AII02692

SEQ ID NO: 254 - protein, 540 aa, Artificial Sequence; identical to SEQ ID NO: 65
  capsid_protein_VP1__Norovirus__AII02695

SEQ ID NO: 255 - protein, 540 aa, Artificial Sequence; identical to SEQ ID NO: 15
  capsid_protein_VP1__Norovirus__AII02698

SEQ ID NO: 256 - protein, 540 aa, Artificial Sequence; identical to SEQ ID NO: 15
  capsid_protein_VP1__Norovirus__AII02701

SEQ ID NO: 257 - protein, 540 aa, Artificial Sequence; identical to SEQ ID NO: 15
  capsid_protein_VP1__Norovirus__AII02707

SEQ ID NO: 258 - protein, 540 aa, Artificial Sequence; identical to SEQ ID NO: 69
  capsid_protein_VP1__Norovirus__AII02710

SEQ ID NO: 259 - protein, 548 aa, Artificial Sequence
  capsid_protein_VP1__Norovirus__AII02713
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQNQPTIFTPVGIGVDHEADFQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 260 - protein, 548 aa, Artificial Sequence; identical to SEQ ID NO: 233
  capsid_protein_VP1__Norovirus__AII02716

SEQ ID NO: 261 - protein, 549 aa, Artificial Sequence
  capsid_protein_VP1__Norovirus__AII02719
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENINAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGILIGQTSRSPDSDSTDSAPRRRDHPLHMQLENLDGTQYDPTDEVPAALGAVDFKGTIFGVASQRDTSGTQVGATRAHEVIINTTDPRYTPKLGSVLMYSESQDFETGQPIRFTPIGMGENDWHQWELPNYSGRLTLNMNLAPAVAPAFPGERILFFRSIVPSAGGYGSGQIDCLLPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 262 - protein, 549 aa, Artificial Sequence
  capsid_protein_VP1__Norovirus__AII02722
MKMASNDAAPSNDGAANLVPEANNEVMALEPVAGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENINAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGRLIGQTSRSPDLDSTDSAPRRRDHPLHMQLENLDGTQYDPTDEVPAALGAVDFKGTIFGVASQRDTSGSQVGATRAHEVTINTTDPRYTPKLGSVLMYSESQDFETGQPIRFTPIGMGEDDWHQWELPNYSGRLTLNMNLAPAVAPAFPGERILFFRSIVPSAGGYGSGQIDCLLPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 263 - protein, 540 aa, Artificial Sequence
  capsid_protein_VP1__Norovirus__AII02725
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPVPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 264 - protein, 540 aa, Artificial Sequence
  capsid_protein_VP1__Norovirus__AII02728
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTRGDGSTRGHKATVYTGSAPFAPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 265 - protein, 550 aa, Artificial Sequence
  capsid_protein_VP1__Norovirus__AII02731
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARNHPLHVQVKNLDGTQYDPTDDIPAVLGAIDFKGTVFGVASQRDVSGTQEQGHYATRAHEAHIDTTDPKYAPKLGTILIKSESTDFNTNQPIRFTPVGMGDNNWRQWELPDYSGSLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 266 - protein, 540 aa, Artificial Sequence; identical to SEQ ID NO: 15
  capsid_protein_VP1__Norovirus__AII02734

SEQ ID NO: 267 - protein, 540 aa, Artificial Sequence; identical to SEQ ID NO: 15
  capsid_protein_VP1__Norovirus__AII02737

SEQ ID NO: 268 - protein, 540 aa, Artificial Sequence
  capsid_protein_VP1__Norovirus__AII02740
MKMAPNDANPSDGSAANLVPEVSNEVMALEPVVGAAIAAPVAGQQNVIDPWIRNNFVQAPGGEFTVSPRNAPGEILWGAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHNGQHDLVIPPNGYFRFDSWVNQFYTLAPMGNGTGRRRAL

SEQ ID NO: 269 - protein, 540 aa, Artificial Sequence; identical to SEQ ID NO: 48
  capsid_protein_VP1__Norovirus__AII02743

SEQ ID NO: 270 - protein, 540 aa, Artificial Sequence; identical to SEQ ID NO: 248
  capsid_protein_VP1__Norovirus__AII02746

SEQ ID NO: 271 - protein, 540 aa, Artificial Sequence; identical to SEQ ID NO: 15
  capsid_protein_VP1__Norovirus__AII02749

SEQ ID NO: 272 - protein, 540 aa, Artificial Sequence; identical to SEQ ID NO: 97
  capsid_protein_VP1__Norovirus__AII02752

SEQ ID NO: 273 - protein, 540 aa, Artificial Sequence; identical to SEQ ID NO: 62
  capsid_protein_VP1__Norovirus__AII02758

SEQ ID NO: 274 - protein, 540 aa, Artificial Sequence
  capsid_protein_VP1__Norovirus__AII02761
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHLIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 275 - protein, 540 aa, Artificial Sequence; identical to SEQ ID NO: 15
  capsid_protein_VP1__Norovirus__AII02764

SEQ ID NO: 276 - protein, 540 aa, Artificial Sequence; identical to SEQ ID NO: 15
  capsid_protein_VP1__Norovirus__AII02767

SEQ ID NO: 277 - protein, 548 aa, Artificial Sequence; identical to SEQ ID NO: 233
  capsid_protein_VP1__Norovirus__AII02770

SEQ ID NO: 278 - protein, 540 aa, Artificial Sequence; identical to SEQ ID NO: 15
  capsid_protein_VP1__Norovirus__AII02773

SEQ ID NO: 279 - protein, 549 aa, Artificial Sequence
  capsid_protein_VP1__Norovirus__AII02776
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENINAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGILIGQTSRSPDSDSTDSAPRRRDHPLHMQLENLDGTQYDPTDEVPAALGAVDFKGTIFGVASQRDTSGSQVGATRAHEVIINTTDPRYTPKLGSVLMYSESQDFETGQPIRFTPIGMGENDWHQWELPNYSGRLTLNMNLAPAVAPAFPGERILFFRSIVPSAGGYGSGQMDCLLPQEWIQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 280 - protein, 540 aa, Artificial Sequence; identical to SEQ ID NO: 15
  capsid_protein_VP1__Norovirus__AII02779

SEQ ID NO: 281 - protein, 540 aa, Artificial Sequence; identical to SEQ ID NO: 15
  capsid_protein_VP1__Norovirus__AII02782

SEQ ID NO: 282 - protein, 540 aa, Artificial Sequence
  capsid_protein_VP1__Norovirus__AII02785
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASINWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRRAL

SEQ ID NO: 283 - protein, 548 aa, Artificial Sequence; identical to SEQ ID NO: 233
  capsid_protein_VP1__Norovirus__AII02788

SEQ ID NO: 284 - protein, 548 aa, Artificial Sequence; identical to SEQ ID NO: 233
  capsid_protein_VP1__Norovirus__AII02791

SEQ ID NO: 285 - protein, 540 aa, Artificial Sequence
  capsid_protein_VP1__Norovirus__AII02794
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQSWNSYDPTEEIPAPLGSPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 286 - protein, 540 aa, Artificial Sequence; identical to SEQ ID NO: 15
  capsid_protein_VP1__Norovirus__AII02797

SEQ ID NO: 287 - protein, 540 aa, Artificial Sequence; identical to SEQ ID NO: 15
  capsid_protein_VP1__Norovirus__AII02800

SEQ ID NO: 288 - protein, 540 aa, Artificial Sequence; identical to SEQ ID NO: 264
  capsid_protein_VP1__Norovirus__AII02803

SEQ ID NO: 289 - protein, 540 aa, Artificial Sequence; identical to SEQ ID NO: 15
  capsid_protein_VP1__Norovirus__AII02806

SEQ ID NO: 290 - protein, 540 aa, Artificial Sequence; identical to SEQ ID NO: 248
  capsid_protein_VP1__Norovirus__AII02809

SEQ ID NO: 291 - protein, 548 aa, Artificial Sequence; identical to SEQ ID NO: 233
  capsid_protein_VP1__Norovirus__AII02812

SEQ ID NO: 292 - protein, 540 aa, Artificial Sequence
  capsid_protein_VP1__Norovirus__AII02815
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 293 - protein, 548 aa, Artificial Sequence
  capsid_protein_VP1__Norovirus__AII02818
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTVTPRLFNYYWHIQLDNLNGTPYDPAEDIPGPLGTPDFRGKVFGVASQRNPDATTRAHEAKIDTTSGRFTPKLGSLEISTESDDFYQNQPTRFTPVGIGVDHEADFQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKNGDSPITVPPNGYFRFESWVNPFYTLAPMGTGNGRRRIQ

SEQ ID NO: 294 - protein, 540 aa, Artificial Sequence
  capsid_protein_VP1__Norovirus__AII02821
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 295 - protein, 540 aa, Artificial Sequence; identical to SEQ ID NO: 15
  capsid_protein_VP1__Norovirus__AII02824

SEQ ID NO: 296 - protein, 540 aa, Artificial Sequence; identical to SEQ ID NO: 15
  capsid_protein_VP1__Norovirus__AII02827

SEQ ID NO: 297 - protein, 540 aa, Artificial Sequence; identical to SEQ ID NO: 15
  capsid_protein_VP1__Norovirus__AII02830

SEQ ID NO: 298 - protein, 540 aa, Artificial Sequence
  capsid_protein_VP1__Norovirus__AII02833
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGGVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 299 - protein, 540 aa, Artificial Sequence
  capsid_protein_VP1__Norovirus__AII02836
MKMASNDANPSDGSAANLVPEVSNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 300 - protein, 540 aa, Artificial Sequence; identical to SEQ ID NO: 89
  capsid_protein_VP1__Norovirus__AII02839

SEQ ID NO: 301 - protein, 540 aa, Artificial Sequence; identical to SEQ ID NO: 97
  capsid_protein_VP1__Norovirus__AII02842

SEQ ID NO: 302 - protein, 548 aa, Artificial Sequence; identical to SEQ ID NO: 233
  capsid_protein_VP1__Norovirus__AII02845

SEQ ID NO: 303 - protein, 548 aa, Artificial Sequence; identical to SEQ ID NO: 233
  capsid_protein_VP1__Norovirus__AII02848

SEQ ID NO: 304 - protein, 540 aa, Artificial Sequence; identical to SEQ ID NO: 48
  capsid_protein_VP1__Norovirus__AII02851

SEQ ID NO: 305 - protein, 540 aa, Artificial Sequence; identical to SEQ ID NO: 15
  capsid_protein_VP1__Norovirus__AII02854

SEQ ID NO: 306 - protein, 540 aa, Artificial Sequence
  capsid_protein_VP1__Norovirus__AII02857
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 307 - protein, 540 aa, Artificial Sequence; identical to SEQ ID NO: 15
  capsid_protein_VP1__Norovirus__AII02860

SEQ ID NO: 308 - protein, 540 aa, Artificial Sequence; identical to SEQ ID NO: 15
  capsid_protein_VP1__Norovirus__AII02866

SEQ ID NO: 309 - protein, 540 aa, Artificial Sequence
  capsid_protein_VP1__Norovirus__AII02869
MKMASNDANPTDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 310 - protein, 540 aa, Artificial Sequence; identical to SEQ ID NO: 15
  capsid_protein_VP1__Norovirus__AII02872

SEQ ID NO: 311 - protein, 540 aa, Artificial Sequence; identical to SEQ ID NO: 15
  capsid_protein_VP1__Norovirus__AII02875

SEQ ID NO: 312 - protein, 548 aa, Artificial Sequence; identical to SEQ ID NO: 233
  capsid_protein_VP1__Norovirus__AII02878

SEQ ID NO: 313 - protein, 540 aa, Artificial Sequence; identical to SEQ ID NO: 15
  capsid_protein_VP1__Norovirus__AII02881

SEQ ID NO: 314 - protein, 540 aa, Artificial Sequence; identical to SEQ ID NO: 15
  capsid_protein_VP1__Norovirus__AII02884

SEQ ID NO: 315 - protein, 548 aa, Artificial Sequence; identical to SEQ ID NO: 233
  capsid_protein_VP1__Norovirus__AII02887

SEQ ID NO: 316 - protein, 540 aa, Artificial Sequence; identical to SEQ ID NO: 97
  capsid_protein_VP1__Norovirus__AII02890

SEQ ID NO: 317 - protein, 540 aa, Artificial Sequence; identical to SEQ ID NO: 50
  capsid_protein_VP1__Norovirus__AII02893

SEQ ID NO: 318 - protein, 540 aa, Artificial Sequence
  capsid_protein_VP1__Norovirus__AII02896
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHRSGYVTVAHTGQHDLVIPPNGYFRFDSWVNQFYTLAPMGNGTGRRRAL

SEQ ID NO: 319 - protein, 548 aa, Artificial Sequence
  capsid_protein_VP1__Norovirus__AII02899
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQSQPTRFTPVGIGVDHEADFQQWTLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 320 - protein, 540 aa, Artificial Sequence; identical to SEQ ID NO: 15
  capsid_protein_VP1__Norovirus__AII02902

SEQ ID NO: 321 - protein, 548 aa, Artificial Sequence
  capsid_protein_VP1__Norovirus__AIS24557
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPTDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTRSTSRASDQADAATPRLFNYYWHIQLDNLNGTPYDPAEDIPAPLGTPDFRGKVFGVASQRNPDSTTRAHEAKVDTTSGRFTPKLGSLEISTESGDFDQNQPTRFTPVGIGVDNEADFQQWTLPDYSGQFTHNMNLAPAVAPNFPGEQLLFFRSQLPSSGGRSNGILDCLVPQEWVQHFYQESAPAQTQVALVRYVNPDTGRVLFEAKLHKLGYMTIAKSGDSPITVPPNGYFRFESWVNPFYTLAPMGTGNGRRRIQ

SEQ ID NO: 322 - protein, 539 aa, Artificial Sequence
  capsid_protein_VP1__Norovirus__AIY30135
MRMSDGAAPKADGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPVSGSWVSCFAAEAAYEFQSGTGQVATFTLIEQDGSAYVPGDRAAPLGYPDFSGQLEIEVQTETTKTGDKLKVTTFEMILGPTTNVDQAPYQGKVFASITAAASLDLVDGRVRAVPRSIYGFQDVIPEYNDGLLVPLAPPIGPFLPGEVLLRFRTYMRQLDTADAAAEAIDCALPQEFISWFASNVFTVQSEALLLRYRNTLTGQLLFECKLYSEGYIALSYSGSGPLTFPTDGFFEVVSWVPRLYQLASVGSLATGRTL

SEQ ID NO: 323 - protein, 540 aa, Artificial Sequence
  capsid_protein_VP1__Norovirus__AKE07100
MKMASSDANPSDGSTANLVPEVNNEVMALEPVVGAAIAAPVAGQQNVIDPWIRNNFVQAPGGEFTISPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSIPVLTIEEMTNSRFPIPLEKLFTGPSSAFVVQPQNGRCSTDGVLLGTTQLSPVNICTFRGDVTHIAGSHNYTMNLASQNWNSYDPTEEIPAPLGTPDFVGKIQGVLTQTTRADGSTRGHKATVLTGSANFTPKLGRIQFATDTDNDFETNQNTKFTPVGVIQDGDTAHRNEPQQWVLPSYSGRNTHNVHLAPAVAPTFPGEQLLFFRSTIPGCSGYPNMDLDCLLPQEWVQFFYQEAAPAQSDVALLRFVNPDTGRVLFECKLHKSGYITVAHTGQHDLVIPPNGYFRFDSWVNQFYTLAPMGNGTGRRRAL

SEQ ID NO: 324 - protein, 540 aa, Artificial Sequence
  capsid_protein_VP1__Norovirus__AKE07103
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTESLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHIAGTHNYTMNLATQNWNSYDPTEEIPAPLGTPDFVGKIQGVLTQTTKTDGSTRGHKATVCIGSADFAPKLGRVQFETDTNNDLETNQNTKFTPVGVIQNGETAHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGSHDLVIPPNGYFRFDSWVNQFYTLAPMGNGTGRRRAT

SEQ ID NO: 325 - protein, 540 aa, Artificial Sequence
  capsid_protein_VP1__Norovirus__AKE07106
MKMASSDANPSDGSTANLVPEVNDEVMALEPVVGAALAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDARNNFYHYNQSNESTIKLIAMLYTPLRANNAGDDVFTVSCRVLTRPSLDFDFIFLVPPTVESRTKPFSVPILTVEEMTNSRFPIPLERLFTGPSSAFAVQPQNGRCTTDGVLLGTTQLSPVNICTFRGDVTHTTGSHNYTMNLASQNRSNYDPTEEIPAPLGTPDFVGKIQGALTQTTRADGSTRGHKATVYTGSADFTPKLGRVQFATDTDHDFDTNQNTKFTPVGVIQDGSTTHRNEPQQWVLPSYSGRNTHNVHLAPAVAPTFPGEQLLFFRSTMPGCSGYPNMDLDCLLPQEWVAHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 326 - protein, 572 aa, Artificial Sequence
  capsid_protein_VP1__Norovirus__ALQ12260
MKMASNGAAAPSQDGAANLVPESQQEVLALEPVAGAALAAPVAGQFNAIDPWIKQNFVQAPAGEFTVSPRNAPGEVLMDLELGPEMNPFLAHLAQMYNAYAGGMEVQIILAGNAFTAGKIIVCAVPPNFPPDRLSASQATNFPHVIMDVRTLEPVVLPLPDVRAGFFHYNQLREPRMRLMTLLYTPLRANGTGDDAFTVSCRVLTRPMLDFEFMFLVPPTVESRVTPFSVPTYPVVEMTNSRWPARISGMHVNANQTLAVQFQNGRCTLDGQLMGTTQLCAADVCRMRGRYTSTRADPAGLGWDLDATTLVDGPEARVQARISVSAHLQLEELSGQPYEVYGEQPAPLGTPDFQCRLMGELVRLPSANPVAQSRFRDAFFDTYGALFAPAVGSVTVTVNNSSSSDFANDQPFEFLPIGVEIGNSARYDEFALPSYNGAIGENRHLAPIAAPGFPGENLIFFSSNLPVWDSTSAQSNRRISCLLPNEFIQHFYDLQAPSQSDVALLRYVHPETDRFLFECKLYRDAFLTVNGASYAEFPVNGYSRFDSWVKQFFTLSPVGTGSGRRGRSRKAQ

SEQ ID NO: 327 - protein, 539 aa, Artificial Sequence
  capsid_protein_VP1__Norovirus__BAI49904
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSKSRFPIPLEKLYTGPSSAFVVQPQNGRCTTDGVLLGTTQLSVVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRFLFECKLHKSGYVTVAHTGPHDLVIPPNGYFRFDSWVNQFYTLAPMGNGAGRRRVL

SEQ ID NO: 328 - protein, 540 aa, Artificial Sequence
  capsid_protein_VP1__Norovirus__BAI49905
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPSTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 329 - protein, 540 aa, Artificial Sequence
  capsid_protein_VP1__Norovirus__BAI49906
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTHGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 330 - protein, 540 aa, Artificial Sequence
  capsid_protein_VP1__Norovirus__BAI49907
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGVLTQTTRGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRFTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 331 - protein, 540 aa, Artificial Sequence
  capsid_protein_VP1__Norovirus__BAI49909
MKMASNDATPSDGSTANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 332 - protein, 540 aa, Artificial Sequence
  capsid_protein_VP1__Norovirus__BAI49910
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECELHKSGYVTVAHTGQHDLVIPPNGYFRFDSWVNQFYTLAPMGNGAGRRRAL

SEQ ID NO: 333 - protein, 540 aa, Artificial Sequence
  capsid_protein_VP1__Norovirus__BAI49911
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTRGDGLTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVDPDTGRVLFECKLHKTGYVTVAHTGQHDLVIPPNGYFRFDSWVNQFYTLAPMGNGAGRRRAL

SEQ ID NO: 334 - protein, 540 aa, Artificial Sequence
  capsid_protein_VP1__Norovirus__BAI49912
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGRIQGMLTQTTKGDGSTRGHKATVSTGSVDFTPKLGSVQFATDTDNDFETGQNTRFTPVGVIQDGSSALRNEPQQWVLPDYSGRTVHNVHLAPAVALTFPGEQLLFFRSTMPGCSGYPNMDLDCLLPQEWVQHFYQEAAPSQSDVALLRFVNPDTGRVLFECKLHRAGYVTVAHTGQHDLVIPPNGYFRFDSWVNQFYTLAPMGNGAGRRRAL

SEQ ID NO: 335 - protein, 540 aa, Artificial Sequence
  capsid_protein_VP1__Norovirus__BAI49914
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 336 - protein, 540 aa, Artificial Sequence
  capsid_protein_VP1__Norovirus__BAI49916
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGGVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 337 - protein, 540 aa, Artificial Sequence
  capsid_protein_VP1__Norovirus__BAI49917
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEVTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 338 - protein, 540 aa, Artificial Sequence
  capsid_protein_VP1__Norovirus__BAI49918
MKMASNDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 339 - protein, 540 aa, Artificial Sequence
  capsid_protein_VP1__Norovirus__BAI49919
MKMASNDANPSDGSAANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 340 - protein, 540 aa, Artificial Sequence
  capsid_protein_VP1__Norovirus__BAI49920
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPGFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 341 - protein, 540 aa, Artificial Sequence
  capsid_protein_VP1__Norovirus__BAI49921
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIIDVRQLEPVLIPLPDVRNNFYHYNQSNDSTIKLIAMLYTPLRANNAGEDVFTVSCRVLTRPSLDFDFIFLVPPTVESRTKPFTVPILTVEEMTNSRFPIPLEKLFTGPSGAFVVQPQNGRCTTDGVLLGTTQLSPVNICTLRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 342 - protein, 540 aa, Artificial Sequence
  capsid_protein_VP1__Norovirus__BAI49923
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 343 - protein, 540 aa, Artificial Sequence
  capsid_protein_VP1__Norovirus__BAI49924
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 344 - protein, 540 aa, Artificial Sequence
  capsid_protein_VP1__Norovirus__BAI49925
MKMASNDANPSDGSAANLVPEVNNEVMALEPVVGAAIAAPVAGQQNVIDPWIRNNFVQAPGGEFTVSPRSAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 345 - protein, 540 aa, Artificial Sequence
  capsid_protein_VP1__Norovirus__BAI49926
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLTSLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGINVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 346 - protein, 540 aa, Artificial Sequence
  capsid_protein_VP1__Norovirus__BAI49927
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 347 - protein, 540 aa, Artificial Sequence
  capsid_protein_VP1__Norovirus__BAI49928
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFLIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 348 - protein, 539 aa, Artificial Sequence
  capsid_protein_VP1__Norovirus__BAJ25070
MKMASSDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHYNNQPAPRMRLVAMLYTPLRSNGSGEDVFTVSCRVLTRPTPDFEFTYLVPPSVESKTKPFSLPILTIGELTNSRFPAPIDQLFTSTNNDVVVQPQNGRCTLDGELQGTTQLLSTAICSYRGTTSNPIDDWDDHLLHLTHPNGATYDPTEDVPAPFGTQDFQGILYGMLTQNPQTGGGEAANSRGVYISSTSDKFTPKLGTIGLHHVQGGDVANNQKSKFTPIGIAENGNTPFRQWVLPNYSGRLTLNTNLAPAVGPNFPGEQILFFRSNVPSVQGGHSIEIDCLIPQEWISHFYQESAPSQSDVALIRYVNPDTGRTLFEAKLHRQGFITIATTGNNPVVVPPNGYFRFDSWVNQFYALAPMGTGNGRRRVQ

SEQ ID NO: 349 - protein, 539 aa, Artificial Sequence
  capsid_protein_VP1__Norovirus__BAJ25072
MKMASNDAAPSNDGATGLVPEINTETLPLEPVAGAAIAAPVTGQNNIIDPWIRTNFVQAPNGEFTVSPRNSPGEILMNLELGPDLNPYLAHLARMYNGYAGGVEVQVLLAGNAFTAGKILFAAVPPNFPVDMLSPAQITMLPHLIVDVRTLEPIMIPLPDVRNVFYHYNNQPAPRMRLVAMLYTPLRSNGSGEDVFTVSCRVLTRPTPDFEFTYLVPPSVESKTKPFSLPILTIGELTNSRFPAPIDQLFTSTNNDVVVQPQNGRCTLDGELQGTTQLLSTAVCSYRGTTSNPIDDWDDHLLHLTHPNGATYDPTEDVPAPFGTQDFQGILYGMLTQNPQAGGGEAASSRGVYISSTSDKFTPKLGTIGLHRVQGGAVADNQKSKFTPIGIAENDNTPFRQWVLPNYSGRLTLNTNLAPAVGPNFPGEQILFFRSNVPSVQGGHSIEIDCLIPQEWVSHFYQESAPSQSDVALIRYVNPDTGRTLFEAKLHRQGFITIATTGNNPVVVPPNGYFRFDSWVNQFYALAPMGTGNGRRRVQ

SEQ ID NO: 350 - protein, 535 aa, Artificial Sequence
  capsid_protein_VP1__Norovirus__BAJ25076
MKMASNDANPSSDGSANLVPEISNEVMALEPVAGAAIAAPVAGQQNIIDPWIRNNFVQAPGGEFTVSPRNAPGEVLLNLPLSPDINPYLAHLSRMYNGYAGGVEVEVVLAGNAFTAGKIIFAAVPPNFPPENLSPSQITMLPHIIVDVRQLEPVRIPLPDVRNNFYHYSRENDSTLRLIAMLYTPLRANNAGDDVFTVSCRVLTRPSPDFDFIFLVPPTVESKSKPFTIPMLTIEEMTNSRFPAPLELMTTGPSHDIVVQPQNGRCTIDGVLLGTTQLSPVNICSLRGVPTKRTNGNDNCFVQLENPNGSAYDPTEDIPAVLGSPDFVGELYGTITQRSSDNSTRAHPFTLNTGSPRYTPKIGSVDIRVTDVSDLQDHDPVKLTPVGLSGDRGSIHQWQLPNYSGVATHNMHLAPSVAPLFPGEQILFFRSTVPGCGGYPNSNIDCLIPQEWVQHFYQEGAPARTDVALLRFINPDTGRVLFECKLHKHGFITVAYSGNHDLVMPPNGYFRFESWVNQFHTLAPMGTGSGRRRIQ

SEQ ID NO: 351 - protein, 547 aa, Artificial Sequence
  capsid_protein_VP1__Norovirus__BAN16283
MKMASSDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGDQVGATRAHEVHINTTDPRYTPKLGSILMHSESGDFVTGQPVRFTPIGMGDNDWHQWELPDYSGHLTLNMNLAPAVAPAFPGERILFFRSIVPSAGGYGTGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 352 - protein, 547 aa, Artificial Sequence
  capsid_protein_VP1__Norovirus__BAN16285
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSMVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 353 - protein, 547 aa, Artificial Sequence
  capsid_protein_VP1__Norovirus__BAN16287
MKMASNDAAPSNDGAANLVPEANNEVMALEPVAGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVKNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILIHSESDDFVTGQPVRFTPIGMGDNDWHQWELPDYSGHLTLNMNLAPAVAPAFPGERILFFRSMVPSAGGYGSGQIDCLIPQEWVQHFYQEAAPSQSAVALIRYVNPDTGRNIFEAKLHREGFITVANSGNNPIVVPHNGYFRFEAWVNQFYTLTPMGTGQGRRRNQ

SEQ ID NO: 354 - protein, 547 aa, Artificial Sequence
  capsid_protein_VP1__Norovirus__BAN16289
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVLGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 355 - protein, 547 aa, Artificial Sequence
  capsid_protein_VP1__Norovirus__BAN16291
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQMKNLDGTPYDPTDEVPAVLGAIDFKGTVFGVASQRNTTGNSVGATRAHEVHIDTTNPRYTPKLGSVLMNSESSDFDDGQPIRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 356 - protein, 547 aa, Artificial Sequence
  capsid_protein_VP1__Norovirus__BAN16293
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSVGATRAHEVHIDTTNPRYTPKLGSVLMNSESSDFDDGQPIRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 357 - protein, 547 aa, Artificial Sequence
  capsid_protein_VP1__Norovirus__BAN16295
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQEVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGSSVGATRAHEVHIDTTNPRYTPKLGSVLMHSESSDFDDGQPTRFTPIGMGADDWRQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 358 - protein, 550 aa, Artificial Sequence
  capsid_protein_VP1__Norovirus__BAN16297
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPVLTLGELSNSRFPAAIDMLYTDPNESIVVQPQNGRCTLDGTLQGTTQLVPTQICAFRGTLISQTARAADSVDSPQRARDHPLHVQVKNLDGTQYDPTDDIPAVLGAIDFKGTVFGVASQRDVSGTQEQGHYATRAHEAHIDTTDPKYAPKLGTILIKSDSNDFNTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 359 - protein, 540 aa, Artificial Sequence
  capsid_protein_VP1__Norovirus__BAR42289
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 360 - protein, 538 aa, Artificial Sequence
  capsid_protein_VP1__Norovirus__BAR47616
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGVASQRNVGNDAPGSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 361 - protein, 538 aa, Artificial Sequence; identical to SEQ ID NO: 360
  capsid_protein_VP1__Norovirus__BAR63715

SEQ ID NO: 362 - protein, 538 aa, Artificial Sequence; identical to SEQ ID NO: 360
  capsid_protein_VP1__Norovirus__BAR63718

SEQ ID NO: 363 - protein, 538 aa, Artificial Sequence; identical to SEQ ID NO: 360
  capsid_protein_VP1__Norovirus__BAR63721

SEQ ID NO: 364 - protein, 540 aa, Artificial Sequence
  capsid_protein_VP1__Norovirus__BAS02083
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 365 - protein, 544 aa, Artificial Sequence
  capsid_protein_VP1__Norovirus__CRL46952
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVVNSVKPNSQQFVPHLSSITLDDIVSSGGDYIGTIQWTSPPSDSGGANTNFWKIPDYGSSLSEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 366 - protein, 540 aa, Artificial Sequence
  capsid_protein_VP1__Norovirus__CRL46955
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 367 - protein, 540 aa, Artificial Sequence
  capsid_protein_VP1__Norovirus__CRL46958
MKMASNDANPSDGSAANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTIPILTVEEMTNSRFPIPLEKLYTGPSSAFVVQPQNGRCTTDGVLLGTTQLSPVNICTFRGDVTNIQGSHTYTMNLASLNWNNYDPTEETPAPLGTPDFVGKIQGVLTQTTKGQGSTRGHKATVYTGSASFTPKLGSVQFRTDTQNDFVTHQNTKFTPVGVIQDGDTTHRNEPQQWVLPNYSGVNTHNVHLAPAVAPTIPGEQLLFFRSSMPGCSGYPNMDLDCLVPQEWVQHFYQEAAPALSDVALLRFVNPDTGRVLFECKLHKSGYVTVAHTGHHDLVIPPNGYFRFDSWVNQFYTLAPMGNGTGRRRVL

SEQ ID NO: 368 - protein, 540 aa, Artificial Sequence
  capsid_protein_VP1__Norovirus__CRL46961
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVSHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 369 - protein, 540 aa, Artificial Sequence
  capsid_protein_VP1__Norovirus__CRL46964
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSDFVVQPQNGRCTTDGVLLGTTQLSPVNICTFRGDVTHTTGSRNYTMNLASQNWNNYDPTEETPAPLGTPDFVGKIRGMLTQTTRADGSTRGHKATVYTGSADFAPKLGRVQFETDTDNDFDANQNTKFTPVGVIQDGTTTHRNEPRQWVLPSYSGRNTHNVHLAPAVAPTFPGEQLLFFRSTMPGCSGYPNMDLDCLLPQEWVQFFYQEAAPAQSDVALLRFVNPDTGRVLFECKLHKSGYVTVAHTGPHDLVIPPNGYFRFDSWVNQFYTLAPMGNGTGRRRAV

SEQ ID NO: 370 - protein, 547 aa, Artificial Sequence
  capsid_protein_VP1__Norovirus__CRL46967
MKMASNDAAPSNDGAANLVPEATSEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGSSIGATRAHEVHIDTTNPRYAPKLGSVLMYSESTDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 371 - protein, 548 aa, Artificial Sequence
  capsid_protein_VP1__Norovirus__CRL46970
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNLDTTTRAHEAKIDTTSGRFTPKLGSLEISTESSDFDQSQPTRFTPVGIGVDHEADFQQWTLPDYAGQFTHNMNLAPAVAPNFPGEQLLFFRSHLPSSGGRSNGILDCLVPQEWVQHFYQESAPSQSQVALVRYVNPDTGRVLFEAKLHKLGFMTIAKNGDSPIIVPPNGYFRFESWVNPFYTLAPMGTGNGRRRIQ

SEQ ID NO: 372 - protein, 535 aa, Artificial Sequence
  capsid_protein_VP1__Norovirus__CRL46973
MKMASNDAAPSNDGAAGLVPEVNNETMALEPVAGASIAAPLTGQNNVIDPWIRMNFVQAPNGEFTVSPRNSPGEVLLELELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEARMKLVAMLYTPLRSNGSGDDVFTVSCRVLTRPSPDFDFNYLVPPTVESKTKPFTLPILTIGELSNSRFPVPIDILYTSPNEGVVVQPQNGRSTLDGELLGTTQIVPSNICALRGRINAHVPNEPNQWNLQVTNANGTPFDPTEDVPAPLGTPDFQANIYGVTGQRNSDSSCRAHDGVLATWSPKFTPKLGSVVLGTWEKEDFNINQPTRFTPIGLHNTEHFKQWVLPNYSGMLTLNMNLAPSVAPLFPGEQILFFRSFIPLNGGKSDGAIDCLLPQEWIQHFYQESAPSPTDVALIRYTNPDTGRVLFEAKLHRQGFITVASSGSKPIVVPPNGYFRFDSWVNQFYSLAPMGTGNGRRRVQ

SEQ ID NO: 373 - protein, 540 aa, Artificial Sequence
  capsid_protein_VP1__Norovirus__CRL46976
MKMASNDAAPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 374 - protein, 540 aa, Artificial Sequence
  capsid_protein_VP1__Norovirus__CRL46979
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 375 - protein, 540 aa, Artificial Sequence
  capsid_VP1__Norovirus__ABC96332
MKMAPNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVSICTFRGDVTHIPGTRIYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 376 - protein, 540 aa, Artificial Sequence
  major_capsid_protein_VP1__Norovirus__ADB27027
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFSPKLGRIQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRRAL

SEQ ID NO: 377 - protein, 541 aa, Artificial Sequence
  major_capsid_protein_VP1__Norovirus__AEE10003
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVRVDGTLLGTTPVSGSWVSCFAAEAAYEFQSGTGEVATFTLIEQDGSAYVPGDRAAPLGYPDFSGQLEIEVQTETTKTGDKLKVTTFEMVLGPETNVDQAPYQGRVYASVNAAASLDLVDGRVRAVPRSVYSFQDVIPEYNDGLLVPLAPPIGPFLPGEVLLRFRTYMRQIDTTDAAAEAIDCALPQEFISWFASNAFTVQSEALLLRYRNTLTGQLLFECKLYSEGYIALSYSGSGALTFPTDGFFEVVSWVPRLYQLASVGSLATGRTLKQ

SEQ ID NO: 378 - protein, 541 aa, Artificial Sequence; identical to SEQ ID NO: 377
  major_capsid_protein_VP1__Norovirus__AEE10006

SEQ ID NO: 379 - protein, 541 aa, Artificial Sequence; identical to SEQ ID NO: 377
  major_capsid_protein_VP1__Norovirus__AEE10009

SEQ ID NO: 380 - protein, 541 aa, Artificial Sequence
  major_capsid_protein_VP1__Norovirus__AEE10015
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVRVDGTLLGTTPVSGSWVSCFAAEAAYEFQSGTGEVATFTLIEQDGSAYVPGDRAAPLGYPDFSGQLEIEVQTETTKTGDKLKVTTFEMVLGPETNVDQAPYQGRVYASVNAAASLDLVDGRVRAVPRSVYSFQDVIPEYNDGLLVPLAPPIGPFLPGEVLLRFRTYMRQIDTTDAAAEAIDCALPQEFVSWFASNAFTVQSEALLLRYRNTLTGQLLFECKLYSEGYIALSYSGSGALTFPTDGFFEVVSWVPRLYQLASVGSLATGRTLKQ

SEQ ID NO: 381 - protein, 541 aa, Artificial Sequence; identical to SEQ ID NO: 377
  major_capsid_protein_VP1__Norovirus__AEE10018

SEQ ID NO: 382 - protein, 541 aa, Artificial Sequence; identical to SEQ ID NO: 380
  major_capsid_protein_VP1__Norovirus__AEE10021

SEQ ID NO: 383 - protein, 541 aa, Artificial Sequence
  major_capsid_protein_VP1__Norovirus__AEE10024
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYEFQSGIGEVATFNLIEQDGSAYTPGDRAAPLGYPDFSGQLEIEVQTETTKTGDKLKVTTFEMALGPKTNVDQTPYQGRVFASITVAASLDLVDGRVRAVPRSVYGFQDTIPEYNDGLLVPLAPPIGPFLPGEVLLRFRTYMRQLDATDAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 384 - protein, 541 aa, Artificial Sequence
  major_capsid_protein_VP1__Norovirus__AEE10027
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTMIEQDGSAYVPGDRAAPLGYPDYSGQLEIEVQTETTKTGDKLRVTTFEMILGPTTNVDQAPYQGKVYASLSTSASLNLVDGRVRAVPRSVYSFQDVLPEYNDGLLVPLAPPLGPFLPGEVLLRFRTYMRQLDTADATAQPIDCALPQEFISWFASNNFTVQSDALLIRYRNTLTGQLLFEAKLYSEGYIAVSYSGSGPLTFPTDGFFEVVSWVPRLFQLASVGSLATGRTLKQ

SEQ ID NO: 385 - protein, 535 aa, Artificial Sequence
  major_capsid_protein_VP1__Norovirus__AGI96385
MKMASNDAAPSNDGAAGLVPEVNNETMALEPVAGASIAAPLTGQNNVIDPWIRMNFVQAPNGEFTVSPRNSPGEVLLNLELGPELNPFLAHLSRMYNGYAGGAEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVIVQPQNGRSTLDGELLGTTQLVPSNICALRGRINAQVPDDHHQWNLQVTNANGTSFDPTEDVPTPLGTPDFLANIYGVTSQRNPDNTCRAHDGVLATWSPKFTPKLGSVVLGTWEESDLDLNQPTRFTPVGLYDTNHFDQWILPNYSGRLTLNMNLAPSVAPLFPGEQILFFRSHIPLKGGTSNGAIDCLLPQEWIQHFYQESAPSPTDVALIRYTNPDTGRVLFEAKLHRQGFITVANSGSRPIVVPPNGYFRFDSWVNQFYSLAPMGTGNGRRRVQ

SEQ ID NO: 386 - protein, 547 aa, Artificial Sequence
  major_capsid_protein_VP1__Norovirus__AGI96397
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENINAAQITMCPHVIVDVRQLEPVLLPLPDIRNRFFHYNQENTSRMRLVAMLYTPLRANSGEDVFTVSCRVLTRPAPDFEFTFLVPPTVESKTKPFSLPILTLGELSNSRFPAPIDMLYTDPNEGIVVQPQNGRCTLDGTLQGTTQLVPTQICAFRGTLIGQTSRSPDSTDSAPRRRDHPLHVQLKNLDGTQYDPTDEVPAVLGAIDFKGTVFGVASQRDVSGQQVGATRAHEVHINTTDPRYTPKLGSILMYSESDDFVTGQPVRFTPIGMGDNDWHQWELPDYPGHLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRDQ

SEQ ID NO: 387 - protein, 535 aa, Artificial Sequence
  major_capsid_protein_VP1__Norovirus__AGI96398
MKMASNDAAPSNDGAAGLVPEVNNETMALEPVAGASIAAPLTGQNNVIDPWIRMNFVQAPNGEFTVSPRNSPGEVLLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVIVQPQNGRSTLDGELLGTTQLVPSNICALRGRINAQVPDDHHQWNLQVTNANGTSFDPTEDVPAPLGTPDFLANIYGVTSQRNPDNTCRAHDGVLATWSPKFTPKLGSVVLGTWEESDLDLNQPTRFTPVGLYDTNHFDQWILPNYSGRLTLNMNLAPSVAPLFPGEQILFFRSHIPLKGGTSNGAIDCLLPQEWIQHFYQESAPSPTDVALIRYTNPDTGRVLFEAKLHRQGFITVANSGSRPIVVPPNGYFRFDSWVNQFYSLAPMGTGNGRRRVQ

SEQ ID NO: 388 - protein, 535 aa, Artificial Sequence
  major_capsid_protein_VP1__Norovirus__AGI96399
MKMASNDAAPSNDDAAGLVPEVNNETMALEPVAGASIAAPLTGQNNVIDPWIRMNFVQAPNGEFTVSPRNSPGEVLLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFALPILTIGELSNSRFPVPIDELYTSPNEGVIVQPQNGRSTLDGELLGTTQLVPSNICALRGRINAQVPDDHHQWNLQVTNANGTSFDPTEDVPAPLGTPDFLANIYGVTSQRNPDNTCRAHDGVLATWSPKFTPKLGSVVLGTWEESDLDLNQPTRFTPVGLYDTNHFDQWILPNYSGRLTLNMNLAPSVAPLFPGEQILFFRSHIPLKGGTSNGAIDCLLPQEWIQHFYQESAPSLTDVALIRYTNPDTGRVLFEAKLHRQGFITVANSGSRPIVVPPNGYFRFDSWVNQFYSLAPMGTGNGRRRVQ

SEQ ID NO: 389 - protein, 538 aa, Artificial Sequence
  major_capsid_protein_VP1__Norovirus__AGJ52175
MMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFSFQTQDRDPSQSVTFATNDASFVPYLGSVSPHNGEGFQAGDIIGSLGWISAPSDNSQFNVWAIPKYGSSLQMSPILLLLCSPRLWEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 390 - protein, 546 aa, Artificial Sequence
  major_capsid_protein_VP1__Norovirus__AGX01092
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCFVPPGFTSSSLTIAQATLFPHVIADVRTLEPIEMPLEDVRNVLYHTNDNQPTMRLVCMLYTPLRTGGGSGSSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTARGRLGVRRI

SEQ ID NO: 391 - protein, 548 aa, Artificial Sequence
  major_capsid_protein_VP1__Norovirus__AGX01095
MKMASNDAAPSNDGAAGLVPEISSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGTLTRSTSRASDQADTATPRLFNYYWHIQLDNLNGTPYDPAEDIPAPLGTPDFRGKVFGVASQRNPDATTRAHEAKIDTTSGRFTPKLGSLEISTESGDFDQNQPTRFTPVGIGVDHEPDFQQWALPDYAGQFTHNMNLAPAVAPNFPGEQLLFFRSQLPSSGGRSNGILDCLVPQEWVQHFYQESAPSQTQVALVRYVNPDTGRVLFEAKLHKLRFMTIAKSGDSPITVPPNGYFRFESWVNPFYTLAPMGTGNGRRRIQ

SEQ ID NO: 392 - protein, 540 aa, Artificial Sequence
  major_capsid_protein_VP1__Norovirus__AGX01098
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGVLTQTTRTDGSTRGHKATVYTGSADFAPKLGRVQFETDTDHDFEVNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHNGQHDLVIPPNGYFRFDSWVNQFYTLAPMGNGTGRRRAL

SEQ ID NO: 393 - protein, 540 aa, Artificial Sequence
  major_capsid_protein_VP1__Norovirus__AKI30060
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSINLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 394 - protein, 541 aa, Artificial Sequence
  major_capsid_protein_VP1__Norovirus__BAQ94514
MKMASNDAAPSNDGAASLVPEAINETMPLEPVAGASIAAPVAGQTNIIDPWIRTNFVQAPNGEFTVSPRNSPGEILLNLELGPDLNPYLSHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFFYLVPPSVESKTKSFTLPILTISEMTNSRFPIPIEQLYTAPNETNVVQCQNGRCTLDGELQGTTQLLSSAICSYRGRTLANNDSWDQNLLQLSYPNGASYDPTDEVPAPLGTQDFSGILYGVLTQDNVTEGTGEAKNAKGIYISTTSGKFTPKIGSIGLHSITGDVHHNQQSRFTPVGIAVNENTPFKQWVLPHYSGSLALNTNLAPAVAPTFPGEQLLFFRSRVPCVQGLHGQDAFIDCLLPQEWVNHFYQEAAPSQTDVALIRFVNPDTGRTLFEAKLHRSGFITVSHTGNYPLVIPPNGHFRFDSWVNQFYSLAPMGTGNGRRRIQ

SEQ ID NO: 395 - protein, 541 aa, Artificial Sequence
  major_capsid_protein_VP1__Norovirus__BAQ94516
MKMASNDAAPSNDGAASLVPEAINETMPLEPVAGASIAAPVAGQTNIIDPWIRTNFVQAPNGEFTVSPRNSPGEILLNLELGPDLNPYLSHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFFYLVPPSVESKTKPFTLPILTISEMTNSRFPIPIEQLYTAPNETNVVQCQNGRCTLDGELQGTTQLLSSAICSYRGRTLANNDSWDQNLLQLSYPNGASYDPTDEVPAPLGTQDFSGILYGVLTQDNVTEGTGEAKNAKGIYISTTSGKFTPKIGSIGLHSITGDVHHNQQSRFTPVGIAVNENTPFKQWVLPHYSGSLALNTNLAPAVAPTFPGEQLLFFRSRVPCVQGLHGQDAFIDCLLPQEWVNHFYQEAAPSQTDVALIRFVNPDTGRTLFEAKLHRSGFITVSHTGNYPLVIPPNGHFRFDSWVNQFYSLAPMGTGNGRRRIQ

SEQ ID NO: 396 - protein, 542 aa, Artificial Sequence
  major_capsid_protein_VP1__Norovirus__BAQ94520
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSERTGEAKNAKGIYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRVQ

SEQ ID NO: 397 - protein, 542 aa, Artificial Sequence
  major_capsid_protein_VP1__Norovirus__BAQ94524
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQHQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSERTGEAKNAKGIYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRVQ

SEQ ID NO: 398 - protein, 542 aa, Artificial Sequence
  major_capsid_protein_VP1__Norovirus__BAQ94526
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTTSELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSERTGEAKNAKGIYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGYFRFDSWVNQFYSLAPMGTGNGRRRVQ

SEQ ID NO: 399 - protein, 528 aa, Artificial Sequence
  VP1_capsid_protein__Norovirus__ACV89840
MMMASSDATPPSEGATNLVPEVNTQVVPLEPVAGAAAAAPFTGQNNVIDPWIFQNFVQAPQGEFTVSPRNTPGEILLRIPLGPNLNPFLAHLSRMYNAWVGGMEAEMILAGNAFTAGKLLIVALPPGFEATQLTPAQATAFPHVIADVRTLEPIPIPLPDIRNVLFHYNGDPTPTIQIVVMLYTPLRTNGNGDDVFTVSGRLLTRPAPDFSFSFLVPPTVEQKTRSFTLPNLAVSDLSNSRFPAPVNILRADPNTTLALDYQNGRCTLDGALQGTTPTNSSFLGYLRGTVDRVNSDQVHVHLREPNGDPFQLGLPGPQGVPDYRATLDIYVDWENKNHGNPCEGTLNTGSQTEYTPGLGTLTFNKTSGDTPEQGDPVIMRLVAFRSNLTDQLPAYNGAFGQGENLAPPVSPPVPGEVFLQFGSRYTRLGERELAVQCLLPSEWITHFYSEAAPIQGEAMLLRYVQPDLGRILFEAKLYKEGFVTVAGGTNPVTFPIDGTFVAVSWVSRNFVLSPMGSGQGRRRAALAE

SEQ ID NO: 400 - protein, 528 aa, Artificial Sequence
  VP1_capsid_protein__Norovirus__ACV89843
MMMASSDATPPSEGATNLVPEVNTQVVPLEPVAGAAAAAPFTGQNNVIDPWIFQNFVQAPQGEFTVSPRNTPGEILLRIPLGPNLNPFLAHLSRMYNAWVGGMEAEMILAGNAFTAGKLLIVALPPGFEATQLTPAQATAFPHVIADVRTLEPIPIPLPDIRNVLFHYNGDPTPTIQIVVMLYTPLRTNGNGDDVFTVSGRLLTRPAPDFSFSFLVPPTVEQKTRPFTLPNLAVSDLSNSRFPAPVNILRADPNTTLALDYQNGRCTLDGALQGTTPTNSSFLGYLRGTVDRVNSDQVHVHLREPNGDPFQLGLPGPQGVPDYRATLDIYVDWENKNHGNPCEGTLNTGSQTEYTPGLGTLTFNKTSGDTPEQGDPVIMRLVAFRSNLTDQLPAYNGAFGQGENLAPPVSPPVPGEVFLQFGSRYTRLGERELAVQCLLPSEWITHFYSEAAPIQGEAMLLRYVQPDLGRILFEAKLYKEGFVTVAGGTNPVTFPIDGTFVAVSWVSRNFVLSPMGSGQGRRRAALAE

SEQ ID NO: 401 - protein, 588 aa, Artificial Sequence
  VP1_capsid_protein__Norovirus__AFV48046
MRLQWEAWRSTFPGMQPPCVGCGLGPSLLRPRRIVQPYLLMRMSDAVHRGNAADTQGASAGEGSNLVPSTVDQAIPIQPVAGAAIAAPTAGQVNQIDPWIRENFVQCPLGEFTVSPRNTPGEVLFNLALGPGLNPYLSHLAAMYTGWVGNMEVQLVLAGNAFTAGKVVVALIPPYFNMQTLTTSQITCFPHIMCDVRTLEPILLPLLDVRRTLWHPTNSEDDTMRLVCMLYTPLRTNSPGDESFVVSGRLLSRPSLDFNFLYLTPPIAQTPYELPTVPRMVPSEMTHSRWPAPIYQVVADPSLVANPQWQNGRVTIDGQLLGTTPISSTWVCSIAGTADYRYIAGTDSFEECKLALSQPNGSPFVVGDAPAPYGYPDFNATISFSFQVETRQNSAYSVREFSLTTSSQTINQSPYTGTVYMDRSETQDYQYQDDRIRGVPHSVQSFKDQLPDYVESGQPPNLAPPIGPFMPGEVLVRFRTYVRQEATAALYQDQPIDCALPQEFVTHLATHGYTLGSDALLLRYRNLRTGQLICEAKLYAEGFLAISYSGTGPLQLPTDGVFEVVSWVQRLYQLAPVGTSTAGRSLGS

SEQ ID NO: 402 - protein, 588 aa, Artificial Sequence
  VP1_capsid_protein__Norovirus__AFV48048
MRLQWEAWRSTFPGMQPPCVGCGLGPSLLRPRRIVQPYLLMRMSDAVHRGNAADTQGASAGEGSNLVPSTVDQAIPIQPVAGAAIAAPTAGQVNQIDPWIRENFVQCPLGEFTVSPRNTPGEVLFNLALGPGLNPYLSHLAAMYTGWVGNMEVQLILAGNAFTAGKVVVALIPPYFNMQTLTTSQITCFPHIMCDVRTLEPILLPLLDVRRTLWHPTNSEDDTMRLVCMLYTPLRTNSPGDESFVVSGRLLSRPSLDFNFLYLTPPIAQTPYELPTVPRMIPSEMTHSRWPAPIYQVVADPSLLANPQWQNGRVTIDGQLLGTTPISSTWVCSIAGTADYRYISGSDSFEECKLALSQPNGSPFVVGDAPAPYGYPDFSATISFSFQVETRQNSAYSVREFSLTTSSQTINQSPYTGTVYMDRSETLDYQYQDDRIRGVPHSVHAFRDQLPDYVESGQPPNLAPPIGPFMPGEVLLRFRTYVRQEATAALYQDQPIDCALPQEFVTHLATHGYTLGSDALLLRYRNLRTGQLICEAKLYAEGFLAISYSGTGPLQLPIDGVFEVVSWVQRLYQLAPVGTSTAGRSLAS

SEQ ID NO: 403 - protein, 540 aa, Artificial Sequence
  VP1_capsid_protein__Norovirus__AGH06682
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQSSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 404 - protein, 539 aa, Artificial Sequence
  VP1_capsid_protein__Norovirus__AGL98413
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGTSHDYTMNLVSQNWNNYDPTEEIPAPLGTPDFVGKIQGLLTQTTRADGSTRAHKATVSTGSVHFTPKLGSVQFTTDTDNDFQTGQNTKFTPVGVIQDGDHHQNEPQQWVLPNYSGTSGHNVHLAPAVAPAFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRRAL

SEQ ID NO: 405 - protein, 539 aa, Artificial Sequence
  VP1_capsid_protein__Norovirus__AGL98414
MKMASSDANPSDGSSANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKIVFAAVPPNFPTEGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPVLTVEEMTNSRFPIPLERLFTGPSTAFVVQPQNGRCTTDGVLLGTTQLSAVNICNFRGEVNHIAGTHDYTMRLTSQNWNNYDPTEEIPAPLGTPDFVGRIQGVLTQTTRSDGSTRSHKATVSTGSVHFTPKLGSVQFTTDTTNDLNAGQNTKFTPVGVEQTSGDHQSEPQQWTLPNYSGTPNHNVHLAPAVAPTFPGEQLLFFRSTLPGCGGYPNMNLDCLLPQEWVLHFYQEAAPAQSDVALLRFVNPDTGRVLFECKLHRSGFITVAHSGSHDLVIPPNGYFRFDSWVNQFYTLAPMGNGSGRRRVV

SEQ ID NO: 406 - protein, 538 aa, Artificial Sequence
  VP1_capsid_protein__Norovirus__AGL98416
MKMASNDANPSDGSAANLVPEVNNEVMALEPVVGAAIAAPVAGQQNVIDPWIRNNFVQAPGGEFTVSPRNAPGEILWSMPLSPELNPYLSHLSRMYNGYAGGFEVQVILAGNAFTAGKIIFAAIPPNFPTDGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPILTVDEMTNSRFPTPLEKLHTGPNNSIVVQPQNGRCTIDGVLLGTTQLSTVNICNFRGSTTRAGQSHAYTMNLVSQNWNNYDPTEEIPAPLGTPDFVGKIVGMLSQTTRENSSTRAHKATVSTGDAHFTPKSGSVLFTTDTDDLQNGQNTRFTPVGVAQDGEPHQNEPQQWRLPNYSGTPGHNVHLAPPVAPTFPGEQLLFFRSTMPGCGGYPNMDLDCLLPQEWVRHFYQEAAPAQSDVALLRFVNPDTGRVLFECKLHKAGYITVSHTGPYDLVIPPNGYFRFDSWVNQFYALAPMGTGTGRRRAL

SEQ ID NO: 407 - protein, 542 aa, Artificial Sequence
  VP1,_capsid_protein__Norovirus__BAL60749
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGVISQRDKQNAAGHNEPANRGHDAVVPTYTAQYTPKLGQVQIGTWQTDDLQVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 408 - protein, 542 aa, Artificial Sequence
  VP1,_capsid_protein__Norovirus__BAL60753
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNEPANRGHDAVVPTYTSQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 409 - protein, 542 aa, Artificial Sequence; identical to SEQ ID NO: 408
  VP1,_capsid_protein__Norovirus__BAL60755

SEQ ID NO: 410 - protein, 542 aa, Artificial Sequence
  VP1,_capsid_protein__Norovirus__BAL60759
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGHAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGVISQRDKQNAAGHNEPANRGHDAVVPTYTAQYTPKLGQVQIGTWQTDDLQVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 411 - protein, 542 aa, Artificial Sequence
  VP1,_capsid_protein__Norovirus__BAL60767
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGMPDFQGRVFGIISQRDRHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 412 - protein, 542 aa, Artificial Sequence
  VP1,_capsid_protein__Norovirus__BAL60769
MKMASNDAVPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNEHLYNVTITNLNGSPFDPSEDIPAPLGVPDFQGRVFGVISQRDKHNTPGHNEPANRAHDAVVPTYTAQYTPKLGQVQIGTWQTDDLTDNQPVKFTPVGLNDTEHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 413 - protein, 542 aa, Artificial Sequence
  VP1,_capsid_protein__Norovirus__BAL60771
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 414 - protein, 542 aa, Artificial Sequence
  VP1,_capsid_protein__Norovirus__BAL60773
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 415 - protein, 542 aa, Artificial Sequence
  VP1,_capsid_protein__Norovirus__BAL60775
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 416 - protein, 542 aa, Artificial Sequence; identical to SEQ ID NO: 415
  VP1,_capsid_protein__Norovirus__BAL60777

SEQ ID NO: 417 - protein, 542 aa, Artificial Sequence; identical to SEQ ID NO: 415
  VP1,_capsid_protein__Norovirus__BAL60779

SEQ ID NO: 418 - protein, 542 aa, Artificial Sequence
  VP1,_capsid_protein__Norovirus__BAL60781
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGIVSQRDKHNSPGHNEPANRGHDAVVPTYTAQYTPKLGQIQIGTWQTDDLTVNQPVKFTPVGLNDIEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 419 - protein, 542 aa, Artificial Sequence
  VP1,_capsid_protein__Norovirus__BAL60783
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNEHLYNVTIINLNGSPFDPSEDIPAPLGVPDFQGRVFGVISQRDKHNTPGHNEPANRAHDAVVPTYTAQYTPKLGQIQIGTWQTDDLTNNQPVKFTPVGLNDTEHFDQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 420 - protein, 542 aa, Artificial Sequence
  VP1,_capsid_protein__Norovirus__BAL60785
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGIISQRDKHNSPGQNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 421 - protein, 542 aa, Artificial Sequence; identical to SEQ ID NO: 415
  VP1,_capsid_protein__Norovirus__BAL60791

SEQ ID NO: 422 - protein, 542 aa, Artificial Sequence; identical to SEQ ID NO: 415
  VP1,_capsid_protein__Norovirus__BAL60793

SEQ ID NO: 423 - protein, 542 aa, Artificial Sequence; identical to SEQ ID NO: 415
  VP1,_capsid_protein__Norovirus__BAL60795

SEQ ID NO: 424 - protein, 542 aa, Artificial Sequence; identical to SEQ ID NO: 415
  VP1,_capsid_protein__Norovirus__BAL60797

SEQ ID NO: 425 - protein, 542 aa, Artificial Sequence
  VP1,_capsid_protein__Norovirus__BAL60799
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPAGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 426 - protein, 542 aa, Artificial Sequence; identical to SEQ ID NO: 415
  VP1,_capsid_protein__Norovirus__BAL60801

SEQ ID NO: 427 - protein, 542 aa, Artificial Sequence; identical to SEQ ID NO: 415
  VP1,_capsid_protein__Norovirus__BAL60803

SEQ ID NO: 428 - protein, 542 aa, Artificial Sequence
  VP1,_capsid_protein__Norovirus__BAL60805
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGHAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 429 - protein, 542 aa, Artificial Sequence
  VP1,_capsid_protein__Norovirus__BAL60809
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 430 - protein, 542 aa, Artificial Sequence
  VP1,_capsid_protein__Norovirus__BAL60811
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGDPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 431 - protein, 542 aa, Artificial Sequence; identical to SEQ ID NO: 430
  VP1,_capsid_protein__Norovirus__BAL60813

SEQ ID NO: 432 - protein, 542 aa, Artificial Sequence; identical to SEQ ID NO: 429
  VP1,_capsid_protein__Norovirus__BAL60815

SEQ ID NO: 433 - protein, 542 aa, Artificial Sequence
  VP1,_capsid_protein__Norovirus__BAL60817
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFAPVGLNDTEHFNQWVVPRYAGALNLNINLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 434 - protein, 542 aa, Artificial Sequence; identical to SEQ ID NO: 415
  VP1,_capsid_protein__Norovirus__BAL60819

SEQ ID NO: 435 - protein, 542 aa, Artificial Sequence; identical to SEQ ID NO: 415
  VP1,_capsid_protein__Norovirus__BAL60821

SEQ ID NO: 436 - protein, 542 aa, Artificial Sequence
  VP1,_capsid_protein__Norovirus__BAL60823
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGLEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 437 - protein, 542 aa, Artificial Sequence
  VP1,_capsid_protein__Norovirus__BAL60825
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKSFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 438 - protein, 542 aa, Artificial Sequence; identical to SEQ ID NO: 415
  VP1,_capsid_protein__Norovirus__BAL60827

SEQ ID NO: 439 - protein, 542 aa, Artificial Sequence; identical to SEQ ID NO: 415
  VP1,_capsid_protein__Norovirus__BAL60829

SEQ ID NO: 440 - protein, 542 aa, Artificial Sequence; identical to SEQ ID NO: 415
  VP1,_capsid_protein__Norovirus__BAL60831

SEQ ID NO: 441 - protein, 542 aa, Artificial Sequence
  VP1,_capsid_protein__Norovirus__BAL60833
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 442 - protein, 542 aa, Artificial Sequence
  VP1,_capsid_protein__Norovirus__BAL60835
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPANFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 443 - protein, 542 aa, Artificial Sequence; identical to SEQ ID NO: 429
  VP1,_capsid_protein__Norovirus__BAL60837

SEQ ID NO: 444 - protein, 542 aa, Artificial Sequence; identical to SEQ ID NO: 429
  VP1,_capsid_protein__Norovirus__BAL60839

SEQ ID NO: 445 - protein, 542 aa, Artificial Sequence
  VP1,_capsid_protein__Norovirus__BAL60841
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTSAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 446 - protein, 542 aa, Artificial Sequence; identical to SEQ ID NO: 415
  VP1,_capsid_protein__Norovirus__BAL60843

SEQ ID NO: 447 - protein, 542 aa, Artificial Sequence; identical to SEQ ID NO: 441
  VP1,_capsid_protein__Norovirus__BAL60845

SEQ ID NO: 448 - protein, 542 aa, Artificial Sequence; identical to SEQ ID NO: 429
  VP1,_capsid_protein__Norovirus__BAL60847

SEQ ID NO: 449 - protein, 542 aa, Artificial Sequence
  VP1,_capsid_protein__Norovirus__BAL60849
MKMASNDAAPSTDGAAGLVPESNSEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 450 - protein, 542 aa, Artificial Sequence; identical to SEQ ID NO: 415
  VP1,_capsid_protein__Norovirus__BAL60851

SEQ ID NO: 451 - protein, 548 aa, Artificial Sequence
  VP1__Norovirus__AAT00378
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTVTPRLFNYYWHIQLDNLNGTPYDPAEDIPGPLGTPDFRGKVFGVASQRNPDSTTRAHEAKVDTTAGRFTPKLGSLEISTESDDFDQNQPTRFAPVGIGVDREAGFQQWSLPDYSGQFSRIMSLAPAVAPIFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 452 - protein, 541 aa, Artificial Sequence
  VP1__Norovirus__ABD95934
MKMASNDAAPSNDGAAGLVPEINTETLPLEPVAGAALAAAVTGQSNIIDPWIRTNFVQAPNGEFTVSPRNSPGEVLLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNRPSERMRLVAMLYTPLRSNGSGDDVFTVSCRVLTRPTPDFEFTYLVPPSVESKTKPFSLPILTISELTNSRFPAPIDSLFTAQNNNLNVQCQNGRCTLDGELQGTTQLLPTGICAFRGKISADVQNSHQDRWHMQLTNLNGTPFDPTDDVPAPLGTPDFTGLLFGVASQRNVGGTGNNTTRAHEVVIATTSTQFVPKLGSINFGSESEDFQVGPPTKFTPVGIKIETGHSFRQWDPPNYSGALTLNMNLAPPVAPNFPGEQLLFFRSNVPCAGGVSEGIIDCLLPQEWIQHFYQESAPSQSDVALIRYVNPDTGRTLFEAKLHRTGYITVAHSGDYPLVVPSNGYFRFDSWINQFYSLAPMGTGNGRRRVQ

SEQ ID NO: 453 - protein, 540 aa, Artificial Sequence
  VP1__Norovirus__ABG49509
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIADTHNYTMNLASQNWNNYDPTEEIPAPLGTPDFVGKIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 454 - protein, 540 aa, Artificial Sequence
  VP1__Norovirus__ABP88833
MKMATNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSALVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLPFFRSTMPGCSGYPNMDLDCLLPQEWVQHFYQEAAPSQSDVALLRFVNPDTGRVLFECKLHKAGYVTVAHTGQHDLVIPPNGYFRFDSWVNQSYTLAPMGNGAGRRRAL

SEQ ID NO: 455 - protein, 540 aa, Artificial Sequence
  VP1__Norovirus__ABY27560
MKMASSDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDLETGQNTKFTPVGVVQDGNSAHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 456 - protein, 539 aa, Artificial Sequence
  VP1__Norovirus__ACT76139
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRRAL

SEQ ID NO: 457 - protein, 539 aa, Artificial Sequence
  VP1__Norovirus__ACT76142
MKMASSDANPSDGSTANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKIIFAAIPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVSHFYQEAAPAQSDVALLRFVNPDTGRVLFECKLHKSGYITVAHTGPYDLVIPPNGYFRFDSWVNQFYTLAPMGNGSGRKRVL

SEQ ID NO: 458 - protein, 539 aa, Artificial Sequence
  VP1__Norovirus__ACT76145
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRRAL

SEQ ID NO: 459 - protein, 539 aa, Artificial Sequence
  VP1__Norovirus__ACT76148
MKMASNDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLVSQNWSNYDPTEEIPAPLGTPDFVGKIQGLLTQTTRADGSTRAHKATVSTGSVHFIPKLGSVQFTTDTNNDFQTGQNTKFTPVGVIQDGDHHQNEPQQWVLPNYSGRTGHNVHLAPAVAPTFPGEQLLFFRSTVPGCSGYPNMNLDCLLPQEWVSHFYQEAAPAQSDVALLRFVNPDTGRVLFECKLHKSGYITVAHTGPYDLVLPPNGYFRFDSWVNQFYTLAPMGNGTGRRRAL

SEQ ID NO: 460 - protein, 539 aa, Artificial Sequence
  VP1__Norovirus__ACT76151
MKMASSDANPSDGSAANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVLHFYQEAAPAQSDVALLRFVNPDTGRVLFECKLHKSGYITVAHTGPYDLVIPPNGYFRFDSWVNQFYTLAPMGNGTGRRRAL

SEQ ID NO: 461 - protein, 540 aa, Artificial Sequence
  VP1__Norovirus__ACX31821
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVFTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 462 - protein, 540 aa, Artificial Sequence
  VP1__Norovirus__ACX31837
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 463 - protein, 540 aa, Artificial Sequence
  VP1__Norovirus__ACX31841
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 464 - protein, 540 aa, Artificial Sequence
  VP1__Norovirus__ACX31851
MKMASNDANPSNGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 465 - protein, 540 aa, Artificial Sequence
  VP1__Norovirus__ACX31856
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRRVL

SEQ ID NO: 466 - protein, 540 aa, Artificial Sequence
  VP1__Norovirus__ACX31860
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTEGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 467 - protein, 540 aa, Artificial Sequence
  VP1__Norovirus__ACX31864
MKMASSDANPSDGSTANLVPEVNNEVMALEPVVGAAIAAPVAGQQNVIDPWIRNNFVQAPGGEFTVSPRNAPGEILWSAPLGPDMNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 468 - protein, 540 aa, Artificial Sequence
  VP1__Norovirus__ACX31889
MKMASSDANPSDGSTANLVPEVNNEVMALEPVVGAAIAAPVAGQQNVIDPWIRNNFVQAPGGEFTVSPRNAPGEILWSAPLGPDMNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 469 - protein, 535 aa, Artificial Sequence
  VP1__Norovirus__ACX31893
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEQRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 470 - protein, 582 aa, Artificial Sequence
  VP1__Norovirus__ACX69259
MKMASNDAAPPSSDGAANLVPEINNEVMALEPVAGAQLAAPVAGQFNAIDPWIRQNFVQAPEGEFTVSPRNAPGEILLNLELGPHLNPFLQHLAQMYNAYAGGMEVQVVLAGNAFTAGKIIFAAIPPHFPPERLSAAQATQFPHVIVDVRQLEPIVLPLPDVRHNLFHFNQQNDERMHLVAFLYTPLRANSGNGDDVFTVSCRVLTRPSQDFEFMFLVPPTVEKKTVAFSLPQLAVGEMSNSRWPARITGMVVDPRLPQVLHIQNGRCTLDGTLMGTTQLNPNDICRIRGYFSSSRPELLCEGEESEVNTTPTDSGATGDQTPEVRTGTRATQRWFAVTELNGQVYDPFGDQPAPLGVPDFKARILGALMRLPGTNPTSNSRFEDAWVETNNQTTYAPATGVVAITTNDNSSGNYANDQTCEFVPLGIEITDSAPYNEFDLPSYGGAASSGNRNLAPTVAPTFPGEAILLFGSNMPVYNRSSGTDNKDIRCLLPNEYVQHLYDTQAPSLSDVALVRYVNRDTGRVLFEAKLHRDGFMTVNASSTTVLPVDGYFRFDSWVNQFYALSPVGNASGRRGRSRQAN

SEQ ID NO: 471 - protein, 548 aa, Artificial Sequence
  VP1__Norovirus__ADF47131
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFNQNQPTRFTPVGIGVDHEEDFQQWSLPDYSGQFTHNMNLAPAVAPNFPGEQLLFFRSQLPSSGGRSNGILDCLVPQEWVQHFYQESAPTQTQVALVRYVNPDTGRVLFEAKLHKLGFMTIAKNGDSPITVPPNGYFRFESWVNPFYTLAPTGTENGRRRVQ

SEQ ID NO: 472 - protein, 540 aa, Artificial Sequence
  VP1__Norovirus__ADR78869
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 473 - protein, 540 aa, Artificial Sequence
  VP1__Norovirus__ADR78872
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHISGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVTQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 474 - protein, 540 aa, Artificial Sequence; identical to SEQ ID NO: 472
  VP1__Norovirus__ADR78875

SEQ ID NO: 475 - protein, 540 aa, Artificial Sequence; identical to SEQ ID NO: 472
  VP1__Norovirus__ADR78878

SEQ ID NO: 476 - protein, 540 aa, Artificial Sequence; identical to SEQ ID NO: 472
  VP1__Norovirus__ADR78881

SEQ ID NO: 477 - protein, 540 aa, Artificial Sequence; identical to SEQ ID NO: 472
  VP1__Norovirus__ADR78884

SEQ ID NO: 478 - protein, 540 aa, Artificial Sequence
  VP1__Norovirus__ADR78887
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 479 - protein, 540 aa, Artificial Sequence; identical to SEQ ID NO: 472
  VP1__Norovirus__ADR78890

SEQ ID NO: 480 - protein, 540 aa, Artificial Sequence; identical to SEQ ID NO: 472
  VP1__Norovirus__ADR78893

SEQ ID NO: 481 - protein, 540 aa, Artificial Sequence; identical to SEQ ID NO: 472
  VP1__Norovirus__ADR78896

SEQ ID NO: 482 - protein, 540 aa, Artificial Sequence
  VP1__Norovirus__ADR78899
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGAPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 483 - protein, 540 aa, Artificial Sequence; identical to SEQ ID NO: 472
  VP1__Norovirus__ADR78902

SEQ ID NO: 484 - protein, 540 aa, Artificial Sequence; identical to SEQ ID NO: 472
  VP1__Norovirus__ADR78905

SEQ ID NO: 485 - protein, 540 aa, Artificial Sequence
  VP1__Norovirus__ADR78908
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 486 - protein, 540 aa, Artificial Sequence
  VP1__Norovirus__ADR78911
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQLSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 487 - protein, 540 aa, Artificial Sequence
  VP1__Norovirus__ADR78914
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 488 - protein, 540 aa, Artificial Sequence
  VP1__Norovirus__ADR78917
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 489 - protein, 540 aa, Artificial Sequence
  VP1__Norovirus__ADR78920
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGDTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 490 - protein, 540 aa, Artificial Sequence
  VP1__Norovirus__ADR78923
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 491 - protein, 540 aa, Artificial Sequence
  VP1__Norovirus__ADR78929
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 492 - protein, 540 aa, Artificial Sequence
  VP1__Norovirus__ADR78932
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGSRNYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 493 - protein, 540 aa, Artificial Sequence
  VP1__Norovirus__ADR78938
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRSYRMNLASQNWNNYDPTEEIPAPLGTPDFVGKIQGMLTQTTKRDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 494 - protein, 540 aa, Artificial Sequence; identical to SEQ ID NO: 335
  VP1__Norovirus__ADR78941

SEQ ID NO: 495 - protein, 540 aa, Artificial Sequence
  VP1__Norovirus__ADR78944
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGSRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 496 - protein, 540 aa, Artificial Sequence; identical to SEQ ID NO: 335
  VP1__Norovirus__ADR78947

SEQ ID NO: 497 - protein, 540 aa, Artificial Sequence
  VP1__Norovirus__ADR78950
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKIIFAAVPPTFPTEGLSPSQVTMFPHIIVDVRQLEPVLIPLPDVRNNFYHYNQSNDSTIKLVAMLYTPLRANNAGDDVFTVSCRVLTRPSPDFDFIFLVPPTVESRTKPFTVPILTVEEMTNSRFPIPLERLFTGPSSAFVVQPQNGRCTTDGVLLGTTQLSPVNICTFRGDVTNIPGSRTYRMNLASQNWNNYDPTEEIPAPLGTPDFVGKIQGVLTQTTKGDGSTRGHKATVRTGSADFTPKLGSVQFATDTDNDFVTGQNTRFTPVGVIHDGSSAHRNEPQQWVLPEYSGRSVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 498 - protein, 540 aa, Artificial Sequence
  VP1__Norovirus__ADR78956
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 499 - protein, 550 aa, Artificial Sequence
  VP1__Norovirus__AEA02124
MMMASKDATSNMDGTSGAGQLVPENNNTSEPINMEPVAGAVTAAATAGQVNMIDPWIMNNYVQAPQGEFTISPNNTPGDILFDLQLGPHLNPFLAHLSQMYNGWVGNMKVRVVLAGNAFSAGKIIVCCIPPGFSAPNISIAQATMFPHVIADVRVLEPIDIPLDDVRNVLFHTNDNGNQTMRLLCMLYTPLRSGGTSSGTDPFVIAGRVLTCPTPDFNFLFLVPPTVEQKTKQFSVPNLPLNVMSNSRVPSLLNAMVVSPDQAQVVQFQNGRCTLDGQMLGTTTVSASCVARFRGKTFQAPDNRLGINLAEISGEPYHAFESPAPLGFPDFGDGDWHVTATKVTPSQLEANDPVVVGNVQPYNPQFAPHLGTLVVENPTPDQVATGTDLLFNITWLSNRANNRFNPWVIPNYGSTLTEAAQLAPSIFPPGFGETIVYFNSTFPAVGATTHAAIPCLLPQEFVAHFVNEQAPIRGEAALLHYIDPDTHRNLGEFKIYPEGFVTCVPNVGGTGPQSLPTNGVFVFVSWVSRYYQLKPVGTAGQARRLGFRRV

SEQ ID NO: 500 - protein, 548 aa, Artificial Sequence
  VP1__Norovirus__AED02033
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLIRSTSRASDQADTSTPRLFNYYWHIQLDNLNGTPYDPAEDIPAPLGTPDFRGKVFGVASQRNPDSTTRAHEAKVDTTSGRFTPKLGSLEIITESDDFDLNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 501 - protein, 548 aa, Artificial Sequence
  VP1__Norovirus__AED02034
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSLTENIVVQCQNGRVTLDGELMGTTQLLPSQICAFRGTLTRSTSRASDQADTATPRLFNYYWHIQLNNLNGTPYDPAEDIPAPLGTPDFRGKVFGVASQRNPDSTTRAHEAKVDTTSGRFAPKLGSLEISTETDDFNQNQPTRFTPVGIGVDNEADFQQWSLPDYSGQFTHNMNLAPAVAPNFPGEQLLFFRSQLPSSGGRSSGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 502 - protein, 548 aa, Artificial Sequence
  VP1__Norovirus__AED02035
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRTGDQADTASPRLFNYYWHIQLDNLNGTPYDPAEDIPAPLGTPDFRGKVFGVASQRNPDSTTRAHEAKVDTTSGRFAPKLGSLEISTESDDFDSNQPTRFTPVGIGVDRETDFQQWTLPEYSGQFTHNMNLAPAVAPNFPGEQLLFFRSQLPSSGGRSGGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 503 - protein, 548 aa, Artificial Sequence
  VP1__Norovirus__AED02037
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTESIVVQCQNGRVTLDGELMGTTQLLPNQICAFRGTLTRSTNRASDQADTATPRLFNHHWHIQLDNLNGTPYDPAEDIPAPLGTPDFRGKVFGVASQRNPDSTTRAHEAKVDTTSGRFTPKLGSLEITTESDDFDPNQSTKFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 504 - protein, 548 aa, Artificial Sequence
  VP1__Norovirus__AED02038
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRAGDQADTATPRLFNYYWHIQLDNLNGTPYDPAEDIPAPLGTPDFRGKVFGVASQRNPDSTTRAHEAKVDTTSGRFAPKLGSLEISTESSDFDSNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 505 - protein, 548 aa, Artificial Sequence
  VP1__Norovirus__AED02039
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRAGDQADTATPRLFNYYWHIQLDNLNGTPYDPAEDIPAPLGTPDFRGKVFGVASQRNPDSTTRAHEAKVDTTSGRFAPKLGSLEISTESSDFDSNQPTRFTPVGIGVDNEADFQQWSLPDYSGQFTHNMNLAPAVAPNFPGEQLLFFRSQLPSSGGRSHGILDCLVPQEWVQHFYQESAPAQTQVALVRYVNPDTGRVLFEAKLHKLGFMTIAKNGDSPITVPPNGYFRFESWVNPFYTLAPMGTGNKRRRIQ

SEQ ID NO: 506 - protein, 540 aa, Artificial Sequence
  VP1__Norovirus__AEG79290
MKMASNDANPSDGSAANLVPEVNNEVMALEPVAGAALAAPVAGQQNVIDPWIRNNFVQAPGGEFTVSPRNAPGEILWSAPLSPDLNPYLSHLARMYNSYAGGFEVQVILAGNAFTAGKIIFAAVPPNFPIEGLSPSQVTMFPHIIVDVRQLEPVLIPLPDVRNNFYHYNQSNEPTIKLIAMLYTPLRANNAGEDVFTVSCRVLTRPSPDFDFIFLVPPTVESRTKPFTVPILTVEEMTNSRFPIPLEKLFTGPSSSFVVQPQNGRCTTDGVLLGTTQLSPVNICTFRGDVTHIAGSRNYTMNLASINWNNYDPTEEIPAPLGTPDFVGKIQGMLTQTTRGDGSTRGHRATVYTGSAPFTPKLGSVQFTTDTDNDFETNQNTKFTPVGVVQDGDTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 507 - protein, 535 aa, Artificial Sequence
  VP1__Norovirus__AEI29586
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNIDGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 508 - protein, 540 aa, Artificial Sequence
  VP1__Norovirus__AEJ82646
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNVFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLAPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSIQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 509 - protein, 540 aa, Artificial Sequence
  VP1__Norovirus__AER11308
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 510 - protein, 540 aa, Artificial Sequence
  VP1__Norovirus__AER11310
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTVNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 511 - protein, 540 aa, Artificial Sequence
  VP1__Norovirus__AER11312
MKIASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIASTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 512 - protein, 540 aa, Artificial Sequence
  VP1__Norovirus__AER11314
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 513 - protein, 540 aa, Artificial Sequence; identical to SEQ ID NO: 472
  VP1__Norovirus__AER11316

SEQ ID NO: 514 - protein, 540 aa, Artificial Sequence; identical to SEQ ID NO: 472
  VP1__Norovirus__AER11318

SEQ ID NO: 515 - protein, 540 aa, Artificial Sequence
  VP1__Norovirus__AER11320
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 516 - protein, 540 aa, Artificial Sequence; identical to SEQ ID NO: 472
  VP1__Norovirus__AER11324

SEQ ID NO: 517 - protein, 540 aa, Artificial Sequence
  VP1__Norovirus__AER11326
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIYLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 518 - protein, 540 aa, Artificial Sequence; identical to SEQ ID NO: 485
  VP1__Norovirus__AER11328

SEQ ID NO: 519 - protein, 540 aa, Artificial Sequence
  VP1__Norovirus__AER11330
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 520 - protein, 540 aa, Artificial Sequence; identical to SEQ ID NO: 20
  VP1__Norovirus__AER11332

SEQ ID NO: 521 - protein, 540 aa, Artificial Sequence; identical to SEQ ID NO: 485
  VP1__Norovirus__AER11334

SEQ ID NO: 522 - protein, 540 aa, Artificial Sequence
  VP1__Norovirus__AER11336
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFNTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 523 - protein, 540 aa, Artificial Sequence
  VP1__Norovirus__AER11340
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 524 - protein, 540 aa, Artificial Sequence; identical to SEQ ID NO: 523
  VP1__Norovirus__AER11342

SEQ ID NO: 525 - protein, 540 aa, Artificial Sequence
  VP1__Norovirus__AER11344
MKMASNDASPSDGSAANLVPEVNNEVMALEPVVGAAIAAPVAGQKNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 526 - protein, 540 aa, Artificial Sequence; identical to SEQ ID NO: 523
  VP1__Norovirus__AER11346

SEQ ID NO: 527 - protein, 540 aa, Artificial Sequence
  VP1__Norovirus__AER11348
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSSSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 528 - protein, 540 aa, Artificial Sequence
  VP1__Norovirus__AER11350
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVFLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 529 - protein, 540 aa, Artificial Sequence
  VP1__Norovirus__AER11352
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGGTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 530 - protein, 540 aa, Artificial Sequence
  VP1__Norovirus__AER11354
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVPPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 531 - protein, 540 aa, Artificial Sequence
  VP1__Norovirus__AER11356
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 532 - protein, 540 aa, Artificial Sequence; identical to SEQ ID NO: 22
  VP1__Norovirus__AER11358

SEQ ID NO: 533 - protein, 540 aa, Artificial Sequence
  VP1__Norovirus__AER11360
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHLIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 534 - protein, 548 aa, Artificial Sequence
  VP1__Norovirus__AEX10549
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPTDNLSAAQITMCPHVIVDVRQLEPINLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTRSTSRASDQADTATPRLFNYHWHIQLDNLNGTPYDPAEDIPAPLGTPDFRGKVFGVASQRNPDSTTRAHEAKVDTTSGRFTPKLGSLEISTESGDFDQNQPTRFTPVGIGVDNEADFQQWTLPDYSGQFTHNMNLAPAVAPNFPGEQLLFFRSHLPSSGGRSNGILDCLVPQEWVQHFYQESAPAQTQVALVRYVNPDTGRVLFEAKLHKLGFMTIAKSGDSPITVPPNGYFRFESWVNPFYTLAPMGTGNGRRRIQ

SEQ ID NO: 535 - protein, 540 aa, Artificial Sequence
  VP1__Norovirus__AEX91910
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 536 - protein, 578 aa, Artificial Sequence
  VP1__Norovirus__AFD30970
MKMASSDATPSSDGAGNLVPESQQEVLPLAPVAGAALAAPVVGQQNIIDPWIKENFVQAPQGEFTVSPKNSPGEVLVNLELSPRLNPYLDHLSKMYNAYAGGMEVEIILAGNAFTAGKVLIAAVPPNFPIENISASQASQFPHVIVDVRTLEPIRLPLPDVRTNFFHYTTQEEPRMRIVAWLYTPLRTNGSGDDSFTVSGRILTRPSPDFEFSFLVPPTVETKTVSFSVPGLVVEDMSNSRWPAQINGLVVRGNEAQVVHFQNGRCTTEGTLLGTTTLSINSICGLRGLSVSQASVRGAPALTEEMPPLEDEVADGAAATYTLARAADTTLWLRVEEPDGRPYDIFGDQPAPLGTPDFTAVIVGTAIRPRTASGAYLHDAYVDTTPGDADFTPSTGNTKIVLRGGGSGHVGQGHYWQFRPIAVEGGGSRPQYQEYNLPDYAGPTASNHDLAPPVAPRMPGELLLLFESDMPVWDNGAGAAPAQKIHCLLPNEFITHLFDLQAPALAEAALLRYVHPDSGRTLFECKLYREGYMVVAAPAGRLNFPLDGYFRFDSWVSAFYILSPVGSGQGRRGRSKAA

SEQ ID NO: 537 - protein, 540 aa, Artificial Sequence
  VP1__Norovirus__AFH88383
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHAGDIIGSLGWISAPSDNSQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 538 - protein, 556 aa, Artificial Sequence
  VP1__Norovirus__AFJ21376
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGERHTDIQYQEYELPDYSGQVASNHNLAPPVAPRMPGESLLLFQSNMPVWDDGHGESTPKKIHCLLPQEFIGHFFDRQAPSLGDAALLRYVNQETNRVLFECKLYRDGYITVAASSGLLDFPLDGFFRFDSWVSSFYILSPVGSGQGRRGRVRFQ

SEQ ID NO: 539 - protein, 535 aa, Artificial Sequence
  VP1__Norovirus__AFJ21379
MKMASSDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTMGELTNSRFPVPIDELYTSPNESLVVQPQNGRCALDGELQGTTQLLPTAICSFRGRINQKVSGDNHVWNMQVTNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 540 - protein, 535 aa, Artificial Sequence; identical to SEQ ID NO: 228
  VP1__Norovirus__AFJ21382

SEQ ID NO: 541 - protein, 540 aa, Artificial Sequence
  VP1__Norovirus__AFJ21387
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATIYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 542 - protein, 540 aa, Artificial Sequence; identical to SEQ ID NO: 462
  VP1__Norovirus__AFJ21388

SEQ ID NO: 543 - protein, 540 aa, Artificial Sequence; identical to SEQ ID NO: 472
  VP1__Norovirus__AFJ21389

SEQ ID NO: 544 - protein, 540 aa, Artificial Sequence
  VP1__Norovirus__AFJ21390
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYAMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 545 - protein, 540 aa, Artificial Sequence
  VP1__Norovirus__AFJ21391
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 546 - protein, 540 aa, Artificial Sequence
  VP1__Norovirus__AFJ21392
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDAWVNQFYTLAPMGNGTGRKRAL

SEQ ID NO: 547 - protein, 540 aa, Artificial Sequence; identical to SEQ ID NO: 485
  VP1__Norovirus__AFJ21393

SEQ ID NO: 548 - protein, 540 aa, Artificial Sequence; identical to SEQ ID NO: 472
  VP1__Norovirus__AFJ21394

SEQ ID NO: 549 - protein, 540 aa, Artificial Sequence; identical to SEQ ID NO: 485
  VP1__Norovirus__AFJ21395

SEQ ID NO: 550 - protein, 540 aa, Artificial Sequence; identical to SEQ ID NO: 472
  VP1__Norovirus__AFJ21396

SEQ ID NO: 551 - protein, 540 aa, Artificial Sequence
  VP1__Norovirus__AFJ21397
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLDPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRGDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 552 - protein, 540 aa, Artificial Sequence
  VP1__Norovirus__AFJ21398
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRRAL

SEQ ID NO: 553 - protein, 540 aa, Artificial Sequence
  VP1__Norovirus__AFJ21399
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGNTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 554 - protein, 540 aa, Artificial Sequence; identical to SEQ ID NO: 552
  VP1__Norovirus__AFJ21400

SEQ ID NO: 555 - protein, 540 aa, Artificial Sequence
  VP1__Norovirus__AFJ21401
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEETPAPLGTPDFVGKIQGMLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 556 - protein, 540 aa, Artificial Sequence
  VP1__Norovirus__AFJ21402
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 557 - protein, 540 aa, Artificial Sequence; identical to SEQ ID NO: 556
  VP1__Norovirus__AFJ21403

SEQ ID NO: 558 - protein, 540 aa, Artificial Sequence; identical to SEQ ID NO: 556
  VP1__Norovirus__AFJ21404

SEQ ID NO: 559 - protein, 540 aa, Artificial Sequence
  VP1__Norovirus__AFJ21405
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGAGRRRAL

SEQ ID NO: 560 - protein, 540 aa, Artificial Sequence; identical to SEQ ID NO: 62
  VP1__Norovirus__AFJ21406

SEQ ID NO: 561 - protein, 540 aa, Artificial Sequence
  VP1__Norovirus__AFJ21407
MKMASSDANPSDGSTANLVPEVNNEVMALEPVVGAAIAAPVAGQQNVIDPWVRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSTEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 562 - protein, 540 aa, Artificial Sequence
  VP1__Norovirus__AFJ21409
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 563 - protein, 540 aa, Artificial Sequence
  VP1__Norovirus__AFJ21410
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 564 - protein, 540 aa, Artificial Sequence; identical to SEQ ID NO: 563
  VP1__Norovirus__AFJ21411

SEQ ID NO: 565 - protein, 540 aa, Artificial Sequence; identical to SEQ ID NO: 563
  VP1__Norovirus__AFJ21413

SEQ ID NO: 566 - protein, 540 aa, Artificial Sequence; identical to SEQ ID NO: 62
  VP1__Norovirus__AFJ21414

SEQ ID NO: 567 - protein, 540 aa, Artificial Sequence; identical to SEQ ID NO: 563
  VP1__Norovirus__AFJ21415

SEQ ID NO: 568 - protein, 540 aa, Artificial Sequence; identical to SEQ ID NO: 62
  VP1__Norovirus__AFJ21416

SEQ ID NO: 569 - protein, 540 aa, Artificial Sequence; identical to SEQ ID NO: 563
  VP1__Norovirus__AFJ21417

SEQ ID NO: 570 - protein, 540 aa, Artificial Sequence
  VP1__Norovirus__AFJ21418
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRIQFATDTNNDFDANQNTKFTPVGVIQDGGTTHRNEPQQWVLPSYSGRNTHNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 571 - protein, 540 aa, Artificial Sequence
  VP1__Norovirus__AFJ21419
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 572 - protein, 540 aa, Artificial Sequence; identical to SEQ ID NO: 563
  VP1__Norovirus__AFJ21420

SEQ ID NO: 573 - protein, 540 aa, Artificial Sequence
  VP1__Norovirus__AFJ21421
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAVVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHIGQHDLVIPPNGYFRFDSWVNQFYTLAPMGNGTGRRRAL

SEQ ID NO: 574 - protein, 540 aa, Artificial Sequence; identical to SEQ ID NO: 563
  VP1__Norovirus__AFJ21422

SEQ ID NO: 575 - protein, 540 aa, Artificial Sequence; identical to SEQ ID NO: 58
  VP1__Norovirus__AFJ21423

SEQ ID NO: 576 - protein, 540 aa, Artificial Sequence; identical to SEQ ID NO: 62
  VP1__Norovirus__AFJ21424

SEQ ID NO: 577 - protein, 540 aa, Artificial Sequence
  VP1__Norovirus__AFJ21425
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNNYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 578 - protein, 540 aa, Artificial Sequence; identical to SEQ ID NO: 62
  VP1__Norovirus__AFJ21426

SEQ ID NO: 579 - protein, 540 aa, Artificial Sequence
  VP1__Norovirus__AFJ21428
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPAEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 580 - protein, 540 aa, Artificial Sequence; identical to SEQ ID NO: 62
  VP1__Norovirus__AFJ21429

SEQ ID NO: 581 - protein, 540 aa, Artificial Sequence; identical to SEQ ID NO: 62
  VP1__Norovirus__AFJ21430

SEQ ID NO: 582 - protein, 540 aa, Artificial Sequence; identical to SEQ ID NO: 62
  VP1__Norovirus__AFJ21431

SEQ ID NO: 583 - protein, 540 aa, Artificial Sequence
  VP1__Norovirus__AFJ21432
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 584 - protein, 540 aa, Artificial Sequence
  VP1__Norovirus__AFJ21433
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVQEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 585 - protein, 540 aa, Artificial Sequence
  VP1__Norovirus__AFJ21434
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 586 - protein, 540 aa, Artificial Sequence; identical to SEQ ID NO: 62
  VP1__Norovirus__AFJ21436

SEQ ID NO: 587 - protein, 540 aa, Artificial Sequence; identical to SEQ ID NO: 585
  VP1__Norovirus__AFJ21437

SEQ ID NO: 588 - protein, 540 aa, Artificial Sequence
  VP1__Norovirus__AFJ21438
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHIGQYDLVIPPNGYFRFDSWVNQFYTLAPMGNGTGRRRAL

SEQ ID NO: 589 - protein, 540 aa, Artificial Sequence; identical to SEQ ID NO: 58
  VP1__Norovirus__AFJ21439

SEQ ID NO: 590 - protein, 540 aa, Artificial Sequence
  VP1__Norovirus__AFJ21440
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 591 - protein, 540 aa, Artificial Sequence
  VP1__Norovirus__AFJ21441
MKMASSDANPSDGSTANLVPEVNTEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDAALLRFVNPDTGRVLFECKLHKSGYVTVAHTGQHDLVIPPNGYFRFDSWVNQFYTLAPMGNGTGRRRAL

SEQ ID NO: 592 - protein, 540 aa, Artificial Sequence
  VP1__Norovirus__AFJ21442
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKSFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTDNDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRKRAL

SEQ ID NO: 593 - protein, 540 aa, Artificial Sequence
  VP1__Norovirus__AFJ21443
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 594 - protein, 540 aa, Artificial Sequence
  VP1__Norovirus__AFJ21444
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTAGSHNYTMNLASQNWNSYDPTEEIPAPLGTPDFVGKIQGVLTQTTRADGSTRGHKATVYTGSAEFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 595 - protein, 540 aa, Artificial Sequence; identical to SEQ ID NO: 62
  VP1__Norovirus__AFJ21445

SEQ ID NO: 596 - protein, 540 aa, Artificial Sequence
  VP1__Norovirus__AFJ21446
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 597 - protein, 540 aa, Artificial Sequence; identical to SEQ ID NO: 62
  VP1__Norovirus__AFJ21448

SEQ ID NO: 598 - protein, 540 aa, Artificial Sequence
  VP1__Norovirus__AFJ21451
MKMASNDANPSDGSAANLVPEVNNEVMALEPVVGAAIAAPVAGQQNVIDPWIRNNFVQAPGGEFTVSPRNAPGETLWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTQGDGSTRGHKATVYTGSADFTPKLGSVQFATDTENDFETHQNTKFTPVGVIQDGSTTHRNEPQQWALPSYSGRSAHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 599 - protein, 540 aa, Artificial Sequence
  VP1__Norovirus__AFJ21454
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPSSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 600 - protein, 540 aa, Artificial Sequence
  VP1__Norovirus__AFL70023
MKMASNDANPSDGSTANLVPEVNNEVMALEPVVGAAIAAPVAGQQNVIDPWIRNNFVQAPGGEFTVSPRNAPGEILWSAPLGPDLNPYLAHLARMYNGYAGGFEVQVILAGNAFTAGKIIFAAVPPNFPTEGLSPSQVTMFPHIVVDVRQLEPVLIPLPDVGNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 601 - protein, 550 aa, Artificial Sequence
  VP1__Norovirus__AFN06724
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQESTPRMRLIAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGQQEQGHYATRAHEAHIDTTDPKYAPKLGTILIKSESNDFTTNQPIRFTPVGMGDNNWRQWELPDYSGRLTLNMNLAPAVSPSFPGERILFFRSIVPSAGGFGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 602 - protein, 550 aa, Artificial Sequence
  VP1__Norovirus__AFN06725
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLIAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGQQEQGHYATRAHEAHIDTTDPKYAPKLGTILIKSESNDFTTNQPIRFTPVGMGDNNWRQWELPDYSGRLTLNMNLAPAVSPSFPGERILFFRSIVPSAGGFGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 603 - protein, 542 aa, Artificial Sequence
  VP1__Norovirus__AFN06726
MKMASNDAAPSTDGAAGLVPESNSEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLQDNDHLYNITITNLNGSPFDPSEDIPAPLGVPDFQGRVFGVITQRDKQNAAGQSQPANRGHDAVVPTYTAQYTPKLGQVQIGTWQTDDLKVNQPVKFTPVGLNDTEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 604 - protein, 538 aa, Artificial Sequence
  VP1__Norovirus__AFN06727
MKMASNDATPSDDGAAGLVPEINNEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAELSDQPRYQYQLQLTNLDGSPIDPTDDVPAPLGTPDFQAMLYGVASQRSSRDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWIEHFYQESAPSQSDIALVRFINPDTGRVLFEAKLHKQGFLTIAASGDHPIVMPTNGYFRFEAWVNPFYTLAPVGTGSGRRRIQ

SEQ ID NO: 605 - protein, 548 aa, Artificial Sequence
  VP1__Norovirus__AFN06728
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRASDQADTATPRLFNYYWHIQLDNLNGTPYDPAEDIPAPLGTPDFRGKVFGVASQRNPDSTTRAHEAKVDTTSGRFTPKLGSLEISTESDDFDPNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 606 - protein, 548 aa, Artificial Sequence
  VP1__Norovirus__AFN06729
MKMASNDAAPSNDGAAGLVPEINNEAMALEPVVGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKIKPFTLPILTISEMSNSRFPVPIDSLHTSPTENIVVQCQNGRVTLDGELMGTTQLLPSQICAFRGTLTRSTSRASDQADTATPRLFNYYWHIQLDNLNGTPYDPAEDIPAPLGTPDFRGKVFGVASQRNPDSTTRAHEAKVDTTSGRFTPKLGSLEISTESGDFDPNQPTRFTPVGIGVDNEADFQQWSLPDYSGQFTHNMHLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 607 - protein, 547 aa, Artificial Sequence
  VP1__Norovirus__AFN06730
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSAESTDSAPRVRNHPLHVQLKNLDGTPYDPTDEVPAVLGAIDFKGTVFGVASQRNTTGSSAGATRAHEVHIDTTNPRYTPKLGSVLMYSESTDFDDGQPTRFTPIGMGADDWRQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 608 - protein, 540 aa, Artificial Sequence
  VP1__Norovirus__AFN06731
MKMASNDAAPSSDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVDVMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEANINTGGDQYAPKLAQVKFFSESQDFEVHQPTIFTPVGVAGDTSHPFRQWTLPRYGGHLTNNTHLAPAVAPLFPGEQLLFFRSQIPSSGGHEQGYMDCLVPQEWVQHFYQEAATAQSEVALIRFINPDTGRVLFEAKLHKQGFITVAHTGDNPIVMPPNGYFRFEAWVNQFYSLAPVGTGNGRRRVQ

SEQ ID NO: 609 - protein, 540 aa, Artificial Sequence
  VP1__Norovirus__AFN06732
MKMASNDAAPSNDGATGLVPEINHETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPANRMRLVAMLYTPLRSNGSGDDVFTVSCRVLTRPTPDFEFTYLVPPSVESKTKPFSLPILTISELTNSRFPAPIDSLYTAQNNNLNVQCQNGRCTLDGELQGTTQLLPSGICAFRGKLTADVHQSHDDRWHMQLTNLNGTPFDPTEDVPAPLGTPDFTGLLFGVASQRNVVSNPNTTRAHEAVISTTSSQFVPKLGSINFGSTSDDFQLQQPTKFTPVGIKVESGHDFDQWALPRYSGHLTLNMNLAPPVAPNFPGEQLLFFRSNVPCAGGVSDGVIDCLLPQEWIQHFYQESAPSQSDVALIRYVNPDTGRTLFEAKLHRTGYITVAHSGDYPLVVPSNGYFRFDSWVNQFYSLAPMGTGNGRRRVQ

SEQ ID NO: 610 - protein, 540 aa, Artificial Sequence
  VP1__Norovirus__AFN06733
MKMASNDAAPSNDGAAGLVPESSNEAMALEPVVGASLAAPVTGQTNIIDPWIRTNFVQAPNGEFTVSPRNSPGEVLVNLELGPELNPYLAHLAMMYNGYAGGMEVQVLLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 611 - protein, 540 aa, Artificial Sequence
  VP1__Norovirus__AFN06734
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQAQNQDPSQSVTFATNDASFVPYLGSISPHNGGDFHSGDIIGSLGWISAPSDSSQLNVWTIPKYGSSLPDVTHLAPAVFPPGFGEVILYFHSTFPGSGQPGQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 612 - protein, 543 aa, Artificial Sequence
  VP1__Norovirus__AFN06735
MMMASKDASPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSRVINLTELDGSPFLAFEAPAPTGFPDLGTSDWHVEMSLNSNSQSSGNPILLRDIQPNSSDFVPHLGSVSVTTAIDVAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSARGRLGVRR

SEQ ID NO: 613 - protein, 544 aa, Artificial Sequence
  VP1__Norovirus__AFN06736
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDHDYDPNTSIICTLDWLSQTTGQNNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRLGIRRS

SEQ ID NO: 614 - protein, 544 aa, Artificial Sequence
  VP1__Norovirus__AFN06738
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFASQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNVLSNSRVPSLIKFMMVSQDHGQMVQFQNGRVTLDGQLQGTTPTSASQLCKMRGTVYHASGGQGLNLTEIDGTPYHAFESPAPIGFPDLGDSDWHINASPATTFNTGESVKRLDMEQGSSFAPHLGTVHYTNADYDANTDLICSLEWLSPPSGGTPNKVNPWAIPRYGSTLTEAAQLAPPIYPPGFGEAIVFFMSDFPIANGQDGLKVPCTIPQEFVTHFVNEQAPTRGEAALLHYVDPDTHRNLGEFKLYPEGFMTCVPNSSGSGPQTLPINGVFTFVSWVSRFYQLKPVGTTGPVRRLGIRRS

SEQ ID NO: 615 - protein, 544 aa, Artificial Sequence
  VP1__Norovirus__AFN06739
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFASQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNVLSNSRVPSLIKSMMVSQDHGQMVQFQNGRVTLDGQLQGTTPTSASQLCKMRGTVYHASGGQGLNLTEIDGTPYHAFESPAPIGFPDIGDSDWHINASPATTFDSGESIKRLDMEQGSSFAPHLGTVHYTNADYPANTDLICSLEWLSPPSGGTPNKVNPWTIPRYGSTLTEAAQLAPPIYPPGFGEAIVFFMSDFPIANGQDGLKVPCTIPQEFVTHFVNEQAPTRGEAALLHYVDPDTHRNLGEFKLYPEGFMTCVPNSSGSGPQTLPINGVFTFVSWVSRFYQLKPVGTTGPVRRLGIRRS

SEQ ID NO: 616 - protein, 540 aa, Artificial Sequence
  VP1__Norovirus__AFV08771
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 617 - protein, 540 aa, Artificial Sequence; identical to SEQ ID NO: 214
  VP1__Norovirus__AFV08774

SEQ ID NO: 618 - protein, 540 aa, Artificial Sequence
  VP1__Norovirus__AFV08777
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPSFPIEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGNVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 619 - protein, 540 aa, Artificial Sequence
  VP1__Norovirus__AFV08780
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDHDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 620 - protein, 540 aa, Artificial Sequence
  VP1__Norovirus__AFV08783
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRRAL

SEQ ID NO: 621 - protein, 540 aa, Artificial Sequence
  VP1__Norovirus__AFV08786
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 622 - protein, 540 aa, Artificial Sequence
  VP1__Norovirus__AFV08789
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 623 - protein, 540 aa, Artificial Sequence
  VP1__Norovirus__AFV08792
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTDEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 624 - protein, 540 aa, Artificial Sequence
  VP1__Norovirus__AFV08795
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNDYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 625 - protein, 540 aa, Artificial Sequence
  VP1__Norovirus__AFX95940
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 626 - protein, 539 aa, Artificial Sequence
  VP1__Norovirus__AFZ84663
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRVL

SEQ ID NO: 627 - protein, 540 aa, Artificial Sequence
  VP1__Norovirus__AGG37871
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSEVALLRFVNPDTGRVLFECKLHKSGYVTVAHTGQYDLVIPPNGYFRFDSWVNQFYTLAPMGNGTGRRRAV

SEQ ID NO: 628 - protein, 540 aa, Artificial Sequence
  VP1__Norovirus__AGI96383
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFSTDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 629 - protein, 540 aa, Artificial Sequence
  VP1__Norovirus__AGI99552
MKMASSDANPSDGSAANLVPKVNNEVMALEPVVGAAIAAPVAGQQNVIDPWIKNNFVQAPGGEFTVSPKNAPGEILWSAPLGPDLNPYLSHLAKMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTIGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 630 - protein, 540 aa, Artificial Sequence
  VP1__Norovirus__AGI99553
MKMASSDANPPDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 631 - protein, 540 aa, Artificial Sequence
  VP1__Norovirus__AGI99554
MKMASSDANPSDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 632 - protein, 540 aa, Artificial Sequence
  VP1__Norovirus__AGI99555
MKMASSDANPSDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 633 - protein, 540 aa, Artificial Sequence
  VP1__Norovirus__AGK25882
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRRLEPVLIPLPDVRNNFYHYNQSNDSTIKLIAMLYTPLRANNAGEDVFTVSCRVLTRPSPDFDFIFLVPPTVESRTKPFTVPILTVEEMTYSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNIKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLIIPPNGYFRFDSWVNQFYTLAPMGNGTGRRRAL

SEQ ID NO: 634 - protein, 540 aa, Artificial Sequence
  VP1__Norovirus__AGK25884
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTAKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGCPDMDLDCLLPQEWVQHFYQEAAPAQSDVALLRFVNPDTGRVLFECKLHKSGYVTVAHTGQHDLIIPPNGYFRFDSWVNQFYTLAPMGNGTGRRRAL

SEQ ID NO: 635 - protein, 540 aa, Artificial Sequence
  VP1__Norovirus__AGK25887
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWNNYDPTEEIPAPLGTPDFVGKIQGVLTQTTRTDGSTRGHKATVHTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 636 - protein, 540 aa, Artificial Sequence
  VP1__Norovirus__AGK25890
MKMASSDANPSDGSAANLVPEVNNEVIALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDIAHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECNLHKSGYVTVAHTGQHDLVIPPNGYFRFDSWVNQFYTLAPMGNGTGRRRAV

SEQ ID NO: 637 - protein, 540 aa, Artificial Sequence; identical to SEQ ID NO: 22
  VP1__Norovirus__AGK25892

SEQ ID NO: 638 - protein, 540 aa, Artificial Sequence
  VP1__Norovirus__AGK25898
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLDTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNAHLAPAVAPTFPGEQLLFFRSTMPGCSGYPNMDLDCLLPQEWVQHFYQEAAPAQSDVALLRFVNPDTGRVLFECKLHKSGYVTAAHTGQHDLVIPPNGYFRFDSWVNQFYTLAPMGNGTGRRRAL

SEQ ID NO: 639 - protein, 540 aa, Artificial Sequence
  VP1__Norovirus__AGK25900
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNSASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 640 - protein, 540 aa, Artificial Sequence
  VP1__Norovirus__AGK25902
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTASCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTAHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 641 - protein, 540 aa, Artificial Sequence
  VP1__Norovirus__AGK25905
MKMASNDANPSDGSAANLVPEVNNEVMALEPVVGAAIAAPVAGQQNVIDPWIRNNFAQAPGGEFTVSPRNAPGEILWSAPLGPDLNPYLSHLARMYNGYAGGFEVQVILAENAFTAGKIIFAAVPPNFPTEGLSPSRVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEETTNSRFPIPLEKLFTGPSSAFVVQPQNGRCTTDGVLLGTTQLSPVNICTFRGDVTHIAGSRNYTMNLASLNWNNYVPTEEIPAPLGTPDFVGKVQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 642 - protein, 540 aa, Artificial Sequence
  VP1__Norovirus__AGK25908
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFATVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 643 - protein, 540 aa, Artificial Sequence
  VP1__Norovirus__AGK25910
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPSNFPTEGLSPSQVTMFPHIIVDVRQLEPVLIPLPDVRNNFYHYNQSNDSTIKLIAMLYTLLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATMYTGSADFAPKLGRVQFETDTDHDFEANQNTKFTPVGVIQDGGTTHRNEPQQWVLPSYSGRNTHNVHLAPAVAPTFPGEQLLFFRPTMPGCSGYPNMDLDRLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 644 - protein, 540 aa, Artificial Sequence
  VP1__Norovirus__AGK25912
MKMASNDANPSDGSAANLVPEVDNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLAPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 645 - protein, 540 aa, Artificial Sequence
  VP1__Norovirus__AGK25915
MKMASNDANPSDGSAVNLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDARQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVAHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLLFRSTMPGCSGYPNMDLDCLLPQEWVQHFYQEAAPAQSDVALLRFVNPDTGRVLFECKLHKSGYVTVAHTGQHDLVIPPSGYFRFDSWVNQFYTLAPMGNGTGRRRAL

SEQ ID NO: 646 - protein, 540 aa, Artificial Sequence
  VP1__Norovirus__AGK25917
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSGFPIPLEKLFTGPSSAFVVQPQNGRCTTDGVLLGTTQLSPVNICTFRGDVTHIAGSRNYTMNLASLNWNNYDPTEEIPAPLGTPDFVGKVQGVLTQTTKGDGSTRGHKATVYTGSAPFTPKLGSVQFETDTENDFETHQNTKFTPVGVIQDGGTAHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQRDLVIPPNGYFRFDSWVNQFYTLAPMGNGTGRRRAL

SEQ ID NO: 647 - protein, 540 aa, Artificial Sequence
  VP1__Norovirus__AGK25919
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAHSDVALLRFVNPDTGRVLFECKLHKSGYVTVAHTGQHDLVIPPNGYFRFDSWVNQFYTLAPMGSGTGRRRAV

SEQ ID NO: 648 - protein, 540 aa, Artificial Sequence
  VP1__Norovirus__AGK25921
MKMASSDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYAPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 649 - protein, 540 aa, Artificial Sequence
  VP1__Norovirus__AGK25924
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLSTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 650 - protein, 540 aa, Artificial Sequence
  VP1__Norovirus__AGK25927
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYAPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPNTGRVLFECKLHKSGYVTVAHTGQHDLVIPPNDYFRFDSWVNQFYTLAPMGNGTGRRRAV

SEQ ID NO: 651 - protein, 540 aa, Artificial Sequence
  VP1__Norovirus__AGK25930
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVGNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 652 - protein, 540 aa, Artificial Sequence
  VP1__Norovirus__AGS08025
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 653 - protein, 540 aa, Artificial Sequence; identical to SEQ ID NO: 214
  VP1__Norovirus__AGS08026

SEQ ID NO: 654 - protein, 540 aa, Artificial Sequence
  VP1__Norovirus__AGS08027
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSANGSTRGHKATVYTGSADFSPKLGRVQFATDTNNDFETNQNTKFTPVGVIQDGNTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 655 - protein, 540 aa, Artificial Sequence
  VP1__Norovirus__AGS08028
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQETAPAQSDVALLRFVNPDTGRVLFECKLHKSCYVTVAHTGQHDLVIPPNGYFRFDSWVNQFYTLAPMGNGTGRRRAV

SEQ ID NO: 656 - protein, 540 aa, Artificial Sequence; identical to SEQ ID NO: 62
  VP1__Norovirus__AGS08029

SEQ ID NO: 657 - protein, 540 aa, Artificial Sequence; identical to SEQ ID NO: 62
  VP1__Norovirus__AGS08030

SEQ ID NO: 658 - protein, 540 aa, Artificial Sequence; identical to SEQ ID NO: 62
  VP1__Norovirus__AGS08031

SEQ ID NO: 659 - protein, 540 aa, Artificial Sequence; identical to SEQ ID NO: 22
  VP1__Norovirus__AGS08032

SEQ ID NO: 660 - protein, 540 aa, Artificial Sequence
  VP1__Norovirus__AGS08033
MKMASSDANPSDGSVANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 661 - protein, 540 aa, Artificial Sequence
  VP1__Norovirus__AGS08035
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRINGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 662 - protein, 540 aa, Artificial Sequence; identical to SEQ ID NO: 214
  VP1__Norovirus__AGS08036

SEQ ID NO: 663 - protein, 540 aa, Artificial Sequence; identical to SEQ ID NO: 62
  VP1__Norovirus__AGS08037

SEQ ID NO: 664 - protein, 540 aa, Artificial Sequence
  VP1__Norovirus__AGS08038
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 665 - protein, 540 aa, Artificial Sequence; identical to SEQ ID NO: 62
  VP1__Norovirus__AGS08040

SEQ ID NO: 666 - protein, 540 aa, Artificial Sequence; identical to SEQ ID NO: 214
  VP1__Norovirus__AGS08041

SEQ ID NO: 667 - protein, 540 aa, Artificial Sequence; identical to SEQ ID NO: 22
  VP1__Norovirus__AGS08042

SEQ ID NO: 668 - protein, 540 aa, Artificial Sequence
  VP1__Norovirus__AGS08043
MKMASSDANPSDGSTANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANSAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRRAL

SEQ ID NO: 669 - protein, 540 aa, Artificial Sequence
  VP1__Norovirus__AGS08044
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 670 - protein, 540 aa, Artificial Sequence
  VP1__Norovirus__AGS08045
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 671 - protein, 540 aa, Artificial Sequence
  VP1__Norovirus__AGS08047
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 672 - protein, 540 aa, Artificial Sequence; identical to SEQ ID NO: 214
  VP1__Norovirus__AGS08048

SEQ ID NO: 673 - protein, 540 aa, Artificial Sequence
  VP1__Norovirus__AGS08050
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 674 - protein, 540 aa, Artificial Sequence
  VP1__Norovirus__AGS08051
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICAFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 675 - protein, 540 aa, Artificial Sequence
  VP1__Norovirus__AGS08052
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 676 - protein, 540 aa, Artificial Sequence
  VP1__Norovirus__AGS08054
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVADQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 677 - protein, 540 aa, Artificial Sequence
  VP1__Norovirus__AGS08056
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 678 - protein, 540 aa, Artificial Sequence
  VP1__Norovirus__AGS08057
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRADGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 679 - protein, 540 aa, Artificial Sequence
  VP1__Norovirus__AGS08058
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 680 - protein, 540 aa, Artificial Sequence
  VP1__Norovirus__AGS08059
MKMASSDANPSDGSAANLVPEVNNEVMALEPVVGAAIAAPVAGQQNVIDPWIRNNFVQAPGGEFTVSPRNAPGEILWNAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRRAV

SEQ ID NO: 681 - protein, 540 aa, Artificial Sequence
  VP1__Norovirus__AGS08060
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 682 - protein, 540 aa, Artificial Sequence; identical to SEQ ID NO: 22
  VP1__Norovirus__AGS08061

SEQ ID NO: 683 - protein, 540 aa, Artificial Sequence; identical to SEQ ID NO: 677
  VP1__Norovirus__AGS08062

SEQ ID NO: 684 - protein, 540 aa, Artificial Sequence; identical to SEQ ID NO: 669
  VP1__Norovirus__AGS08063

SEQ ID NO: 685 - protein, 540 aa, Artificial Sequence; identical to SEQ ID NO: 214
  VP1__Norovirus__AGS08064

SEQ ID NO: 686 - protein, 540 aa, Artificial Sequence; identical to SEQ ID NO: 62
  VP1__Norovirus__AGS08065

SEQ ID NO: 687 - protein, 540 aa, Artificial Sequence; identical to SEQ ID NO: 669
  VP1__Norovirus__AGS08066

SEQ ID NO: 688 - protein, 540 aa, Artificial Sequence; identical to SEQ ID NO: 214
  VP1__Norovirus__AGS08067

SEQ ID NO: 689 - protein, 540 aa, Artificial Sequence
  VP1__Norovirus__AGS08068
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 690 - protein, 540 aa, Artificial Sequence
  VP1__Norovirus__AGS08069
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 691 - protein, 540 aa, Artificial Sequence
  VP1__Norovirus__AGS08070
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFGVQVILAGNAFTAGKVIFAAVPPNFPTEGLSPSQVTMFPHIVVNVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVALTGQHDLVIPPNGYFRFDSWVNQFYTLAPMGNGTGRRRAV

SEQ ID NO: 692 - protein, 540 aa, Artificial Sequence; identical to SEQ ID NO: 677
  VP1__Norovirus__AGS08071

SEQ ID NO: 693 - protein, 540 aa, Artificial Sequence; identical to SEQ ID NO: 62
  VP1__Norovirus__AGS08072

SEQ ID NO: 694 - protein, 540 aa, Artificial Sequence; identical to SEQ ID NO: 585
  VP1__Norovirus__AGS08073

SEQ ID NO: 695 - protein, 540 aa, Artificial Sequence; identical to SEQ ID NO: 669
  VP1__Norovirus__AGS08074

SEQ ID NO: 696 - protein, 540 aa, Artificial Sequence; identical to SEQ ID NO: 214
  VP1__Norovirus__AGS08076

SEQ ID NO: 697 - protein, 540 aa, Artificial Sequence; identical to SEQ ID NO: 214
  VP1__Norovirus__AGS08079

SEQ ID NO: 698 - protein, 540 aa, Artificial Sequence; identical to SEQ ID NO: 669
  VP1__Norovirus__AGS08080

SEQ ID NO: 699 - protein, 540 aa, Artificial Sequence
  VP1__Norovirus__AGS08081
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFVTDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 700 - protein, 540 aa, Artificial Sequence
  VP1__Norovirus__AGS08082
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFTPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 701 - protein, 540 aa, Artificial Sequence; identical to SEQ ID NO: 214
  VP1__Norovirus__AGS08083

SEQ ID NO: 702 - protein, 540 aa, Artificial Sequence
  VP1__Norovirus__AGS08084
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSYDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTKTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRRAL

SEQ ID NO: 703 - protein, 540 aa, Artificial Sequence
  VP1__Norovirus__AGS08085
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRRAV

SEQ ID NO: 704 - protein, 540 aa, Artificial Sequence; identical to SEQ ID NO: 669
  VP1__Norovirus__AGS08086

SEQ ID NO: 705 - protein, 540 aa, Artificial Sequence
  VP1__Norovirus__AGS08087
MKMASSDANPSDGSTANLVPEVNNEVMALEPVVGAAIAAPVAGQQNVIDPWIRNNFVQAPGGEFTVSPRNAPSTILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 706 - protein, 540 aa, Artificial Sequence; identical to SEQ ID NO: 669
  VP1__Norovirus__AGS08088

SEQ ID NO: 707 - protein, 540 aa, Artificial Sequence; identical to SEQ ID NO: 22
  VP1__Norovirus__AGS08089

SEQ ID NO: 708 - protein, 540 aa, Artificial Sequence; identical to SEQ ID NO: 214
  VP1__Norovirus__AGS08090

SEQ ID NO: 709 - protein, 540 aa, Artificial Sequence
  VP1__Norovirus__AGS08091
MKMASSDANPTDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 710 - protein, 540 aa, Artificial Sequence; identical to SEQ ID NO: 214
  VP1__Norovirus__AGS08092

SEQ ID NO: 711 - protein, 540 aa, Artificial Sequence; identical to SEQ ID NO: 669
  VP1__Norovirus__AGS08093

SEQ ID NO: 712 - protein, 540 aa, Artificial Sequence; identical to SEQ ID NO: 62
  VP1__Norovirus__AGS08094

SEQ ID NO: 713 - protein, 540 aa, Artificial Sequence; identical to SEQ ID NO: 62
  VP1__Norovirus__AGS08095

SEQ ID NO: 714 - protein, 540 aa, Artificial Sequence; identical to SEQ ID NO: 677
  VP1__Norovirus__AGS08096

SEQ ID NO: 715 - protein, 540 aa, Artificial Sequence
  VP1__Norovirus__AGS08097
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 716 - protein, 540 aa, Artificial Sequence
  VP1__Norovirus__AGS08098
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 717 - protein, 540 aa, Artificial Sequence; identical to SEQ ID NO: 214
  VP1__Norovirus__AGS08099

SEQ ID NO: 718 - protein, 540 aa, Artificial Sequence
  VP1__Norovirus__AGS08100
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLVSQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 719 - protein, 540 aa, Artificial Sequence
  VP1__Norovirus__AGS08101
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFITNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRRAL

SEQ ID NO: 720 - protein, 540 aa, Artificial Sequence; identical to SEQ ID NO: 625
  VP1__Norovirus__AGS08102

SEQ ID NO: 721 - protein, 540 aa, Artificial Sequence
  VP1__Norovirus__AGS08103
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 722 - protein, 540 aa, Artificial Sequence; identical to SEQ ID NO: 715
  VP1__Norovirus__AGS08104

SEQ ID NO: 723 - protein, 540 aa, Artificial Sequence; identical to SEQ ID NO: 681
  VP1__Norovirus__AGS08105

SEQ ID NO: 724 - protein, 540 aa, Artificial Sequence; identical to SEQ ID NO: 700
  VP1__Norovirus__AGS08106

SEQ ID NO: 725 - protein, 540 aa, Artificial Sequence; identical to SEQ ID NO: 669
  VP1__Norovirus__AGS08107

SEQ ID NO: 726 - protein, 540 aa, Artificial Sequence
  VP1__Norovirus__AGS08108
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWSSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 727 - protein, 540 aa, Artificial Sequence
  VP1__Norovirus__AGS08109
MKMASSDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 728 - protein, 540 aa, Artificial Sequence
  VP1__Norovirus__AGS08110
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 729 - protein, 540 aa, Artificial Sequence
  VP1__Norovirus__AGS08111
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQYDLVIPPNGYFRFDSWVNQFYTLAPMGNGTGRRRAL

SEQ ID NO: 730 - protein, 540 aa, Artificial Sequence; identical to SEQ ID NO: 214
  VP1__Norovirus__AGS08112

SEQ ID NO: 731 - protein, 540 aa, Artificial Sequence
  VP1__Norovirus__AGS08113
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRAL

SEQ ID NO: 732 - protein, 540 aa, Artificial Sequence; identical to SEQ ID NO: 669
  VP1__Norovirus__AGS08114

SEQ ID NO: 733 - protein, 540 aa, Artificial Sequence; identical to SEQ ID NO: 214
  VP1__Norovirus__AGS08115

SEQ ID NO: 734 - protein, 540 aa, Artificial Sequence; identical to SEQ ID NO: 660
  VP1__Norovirus__AGS08116

SEQ ID NO: 735 - protein, 540 aa, Artificial Sequence
  VP1__Norovirus__AGS08117
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 736 - protein, 540 aa, Artificial Sequence; identical to SEQ ID NO: 669
  VP1__Norovirus__AGS08119

SEQ ID NO: 737 - protein, 540 aa, Artificial Sequence; identical to SEQ ID NO: 715
  VP1__Norovirus__AGS08120

SEQ ID NO: 738 - protein, 540 aa, Artificial Sequence; identical to SEQ ID NO: 669
  VP1__Norovirus__AGS08121

SEQ ID NO: 739 - protein, 540 aa, Artificial Sequence
  VP1__Norovirus__AGS08122
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGNTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRRAL

SEQ ID NO: 740 - protein, 540 aa, Artificial Sequence
  VP1__Norovirus__AGS08124
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSGAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDSDFVTNQNTKFTPVGVIQDGSTTPRNEPQQWVLPSYSGRSTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 741 - protein, 540 aa, Artificial Sequence
  VP1__Norovirus__AGS08125
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSAVFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 742 - protein, 540 aa, Artificial Sequence; identical to SEQ ID NO: 679
  VP1__Norovirus__AGS08126

SEQ ID NO: 743 - protein, 540 aa, Artificial Sequence; identical to SEQ ID NO: 214
  VP1__Norovirus__AGS08127

SEQ ID NO: 744 - protein, 540 aa, Artificial Sequence
  VP1__Norovirus__AGS08128
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 745 - protein, 540 aa, Artificial Sequence
  VP1__Norovirus__AGS08129
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGMLTQTTRTDGSTRGHKATVYTGSVDFSPKLGRVQFTTDTDNDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 746 - protein, 540 aa, Artificial Sequence
  VP1__Norovirus__AGS08130
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRADGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 747 - protein, 540 aa, Artificial Sequence
  VP1__Norovirus__AGS08131
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGNVTHITGSRNYTMNLASQNWNNYDPTEEIPAPLGTPDFVGKIQGVLTQTTRTDGSTRGHKATVYIGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 748 - protein, 540 aa, Artificial Sequence
  VP1__Norovirus__AGS08132
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 749 - protein, 540 aa, Artificial Sequence
  VP1__Norovirus__AGS08133
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 750 - protein, 540 aa, Artificial Sequence
  VP1__Norovirus__AGS08134
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNVCTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 751 - protein, 540 aa, Artificial Sequence
  VP1__Norovirus__AGS08135
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 752 - protein, 540 aa, Artificial Sequence; identical to SEQ ID NO: 669
  VP1__Norovirus__AGS08136

SEQ ID NO: 753 - protein, 540 aa, Artificial Sequence
  VP1__Norovirus__AGS08137
MKMASSDANPSDGSSANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRAL

SEQ ID NO: 754 - protein, 540 aa, Artificial Sequence; identical to SEQ ID NO: 690
  VP1__Norovirus__AGS08138

SEQ ID NO: 755 - protein, 540 aa, Artificial Sequence
  VP1__Norovirus__AGS08139
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 756 - protein, 540 aa, Artificial Sequence
  VP1__Norovirus__AGS08140
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 757 - protein, 540 aa, Artificial Sequence
  VP1__Norovirus__AGS08141
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 758 - protein, 540 aa, Artificial Sequence
  VP1__Norovirus__AGS08142
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRAKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAP

SEQ ID NO: 759 - protein, 540 aa, Artificial Sequence; identical to SEQ ID NO: 22
  VP1__Norovirus__AGS08143

SEQ ID NO: 760 - protein, 540 aa, Artificial Sequence
  VP1__Norovirus__AGS08144
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRRAL

SEQ ID NO: 761 - protein, 540 aa, Artificial Sequence
  VP1__Norovirus__AGS08145
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEETPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 762 - protein, 540 aa, Artificial Sequence; identical to SEQ ID NO: 721
  VP1__Norovirus__AGS08146

SEQ ID NO: 763 - protein, 540 aa, Artificial Sequence; identical to SEQ ID NO: 62
  VP1__Norovirus__AGS08147

SEQ ID NO: 764 - protein, 540 aa, Artificial Sequence; identical to SEQ ID NO: 669
  VP1__Norovirus__AGS08148

SEQ ID NO: 765 - protein, 540 aa, Artificial Sequence
  VP1__Norovirus__AGS08149
MKMASSDANPSDGSTANLVPEVNNEVMALEPVVGAAIAAPVAGQQNVIDPWIRNNFVQAPGGEFTVSPRNAPGEILWNAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGKCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 766 - protein, 540 aa, Artificial Sequence; identical to SEQ ID NO: 715
  VP1__Norovirus__AGS08150

SEQ ID NO: 767 - protein, 540 aa, Artificial Sequence
  VP1__Norovirus__AGS08152
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRANGSTRGHKATVYTGSADFAPKLGRVQFATDTNNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 768 - protein, 540 aa, Artificial Sequence
  VP1__Norovirus__AGS08153
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRADGSTRGHKATVYTGSADFAPKLGRVQFATDTNNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 769 - protein, 540 aa, Artificial Sequence
  VP1__Norovirus__AGS08154
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGTLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 770 - protein, 540 aa, Artificial Sequence; identical to SEQ ID NO: 677
  VP1__Norovirus__AGS08157

SEQ ID NO: 771 - protein, 540 aa, Artificial Sequence
  VP1__Norovirus__AGS08158
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVI

SEQ ID NO: 772 - protein, 540 aa, Artificial Sequence; identical to SEQ ID NO: 681
  VP1__Norovirus__AGS08160

SEQ ID NO: 773 - protein, 540 aa, Artificial Sequence
  VP1__Norovirus__AGS08161
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 774 - protein, 540 aa, Artificial Sequence
  VP1__Norovirus__AGS08162
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 775 - protein, 540 aa, Artificial Sequence; identical to SEQ ID NO: 774
  VP1__Norovirus__AGS08163

SEQ ID NO: 776 - protein, 540 aa, Artificial Sequence; identical to SEQ ID NO: 679
  VP1__Norovirus__AGS08164

SEQ ID NO: 777 - protein, 540 aa, Artificial Sequence
  VP1__Norovirus__AGS08165
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 778 - protein, 540 aa, Artificial Sequence; identical to SEQ ID NO: 774
  VP1__Norovirus__AGS08166

SEQ ID NO: 779 - protein, 540 aa, Artificial Sequence
  VP1__Norovirus__AGS08167
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 780 - protein, 540 aa, Artificial Sequence; identical to SEQ ID NO: 777
  VP1__Norovirus__AGS08168

SEQ ID NO: 781 - protein, 540 aa, Artificial Sequence
  VP1__Norovirus__AGS08169
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDIRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 782 - protein, 540 aa, Artificial Sequence; identical to SEQ ID NO: 774
  VP1__Norovirus__AGS08170

SEQ ID NO: 783 - protein, 540 aa, Artificial Sequence
  VP1__Norovirus__AGS08171
MKMASSDANPSDGSAANLVPEVNNEVMALDPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 784 - protein, 540 aa, Artificial Sequence; identical to SEQ ID NO: 679
  VP1__Norovirus__AGS08172

SEQ ID NO: 785 - protein, 540 aa, Artificial Sequence; identical to SEQ ID NO: 777
  VP1__Norovirus__AGS08173

SEQ ID NO: 786 - protein, 540 aa, Artificial Sequence; identical to SEQ ID NO: 774
  VP1__Norovirus__AGS08174

SEQ ID NO: 787 - protein, 540 aa, Artificial Sequence; identical to SEQ ID NO: 673
  VP1__Norovirus__AGS08175

SEQ ID NO: 788 - protein, 540 aa, Artificial Sequence; identical to SEQ ID NO: 774
  VP1__Norovirus__AGS08176

SEQ ID NO: 789 - protein, 540 aa, Artificial Sequence; identical to SEQ ID NO: 777
  VP1__Norovirus__AGS08177

SEQ ID NO: 790 - protein, 540 aa, Artificial Sequence; identical to SEQ ID NO: 774
  VP1__Norovirus__AGS08178

SEQ ID NO: 791 - protein, 540 aa, Artificial Sequence; identical to SEQ ID NO: 774
  VP1__Norovirus__AGS08179

SEQ ID NO: 792 - protein, 540 aa, Artificial Sequence; identical to SEQ ID NO: 774
  VP1__Norovirus__AGS08180

SEQ ID NO: 793 - protein, 540 aa, Artificial Sequence; identical to SEQ ID NO: 777
  VP1__Norovirus__AGS08181

SEQ ID NO: 794 - protein, 540 aa, Artificial Sequence; identical to SEQ ID NO: 777
  VP1__Norovirus__AGS08182

SEQ ID NO: 795 - protein, 548 aa, Artificial Sequence
  VP1__Norovirus__AGT39181
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDREADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 796 - protein, 535 aa, Artificial Sequence
  VP1__Norovirus__AGT39191
MKMASNDAAPSNDGAAGLVPEVTNETMALEPVARASIAAPLTGQNNVIDPWITLNFGQAPTGHLTLSPPYSPGEVLLNLELRPELNPYLANLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQITNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 797 - protein, 535 aa, Artificial Sequence
  VP1__Norovirus__AGT39194
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQITNINGTPFDPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 798 - protein, 535 aa, Artificial Sequence
  VP1__Norovirus__AGT39197
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEENDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 799 - protein, 535 aa, Artificial Sequence
  VP1__Norovirus__AGT39200
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQITNINGTPFGPTEDVPAPLGTPDFSGKLFGVLSQRDHDNACRSHDAVIATNSAKFTPKLGAIQIGTWEQDDVHINQPTKFTPVGLFESEGFNQWTLPNYSGALTLNMGLAPPVAPTFPGEQILFYRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 800 - protein, 535 aa, Artificial Sequence; identical to SEQ ID NO: 228
  VP1__Norovirus__AGT39203

SEQ ID NO: 801 - protein, 542 aa, Artificial Sequence
  VP1__Norovirus__AGT39206
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 802 - protein, 540 aa, Artificial Sequence
  VP1__Norovirus__AHF45991
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIASTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 803 - protein, 540 aa, Artificial Sequence; identical to SEQ ID NO: 22
  VP1__Norovirus__AHF45993

SEQ ID NO: 804 - protein, 540 aa, Artificial Sequence; identical to SEQ ID NO: 679
  VP1__Norovirus__AHF45997

SEQ ID NO: 805 - protein, 540 aa, Artificial Sequence; identical to SEQ ID NO: 679
  VP1__Norovirus__AHF45999

SEQ ID NO: 806 - protein, 540 aa, Artificial Sequence; identical to SEQ ID NO: 679
  VP1__Norovirus__AHF46001

SEQ ID NO: 807 - protein, 538 aa, Artificial Sequence
  VP1__Norovirus__AHH44876
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPVLTVEEMTNSRFPIPLEKLFTGPSSAFVVQPQNGRCTTDGVLLGTTQLSAVNICTFRGDVTHVSDKTFAMNLASPNWNNYDPTEDIPAPLGTPDFVGRIHGMLTQTTRRDGATRGHKATVSTGGADFTPKLGSVRYITDTTDDLEVRENTKFTPIGVLHSSGEHRAEPDQWRLPEYSGRNVHNVHLAPAVAPTFPGEQLLFFRSALPGCGGYPNTDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 808 - protein, 538 aa, Artificial Sequence
  VP1__Norovirus__AHH44877
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSGDLEVRENTKFTPIGVLHSSGERRAEPEQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 809 - protein, 538 aa, Artificial Sequence
  VP1__Norovirus__AHH44878
MKMASSDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 810 - protein, 538 aa, Artificial Sequence
  VP1__Norovirus__AHH44879
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 811 - protein, 538 aa, Artificial Sequence
  VP1__Norovirus__AHH44880
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQETAPAQSDVALLRFVNPDTGRVLFECKLHKSGYVTVAHTGPHDLVIPPNGYFRFDSWVNQFYTLAPMGNGTGRRRAL

SEQ ID NO: 812 - protein, 538 aa, Artificial Sequence
  VP1__Norovirus__AHH44881
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSAVNICTFRGDVTHVAGDTFAMNLASLNWNNYDPTEETPAPLGTPDFVGRIHGMLTQTTRSDGATRAHKATVSTGGADFTPKLGSVRYSTDTSSDLEVRENTKFTPIGVLHSSGGHRAEPDQWRLPEYSGRNVHNVHLAPAVAPTFPGEQLLFFRSTMPGCGGYPNMDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 813 - protein, 538 aa, Artificial Sequence
  VP1__Norovirus__AHH44884
MKMASNDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSIIKLIAMLYTPLRANNAGDDVFTVSCRVLTRPSPDFDFIFLVPPTVESRTKPFTVPVLTVDEMTNSRFPIPLEKLFTGPSSAFVVQPQNGRCTTDGVLLGTTQLSAVNICTFRGDVTHVSDKTFAMNLASPNWNNYDPTEEIPAPLGTPDFVGRIHGMLTQTTRRDGATRGHKATVSTGGADFTPKLGSVRYITDTTDDLEVRENTKFTPIGVLHSSGEHRAEPDQWRLPEYSGRNVHNVHLAPAVAPTFPGEQLLFFRSALPGCGGYPNTDLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 814 - protein, 539 aa, Artificial Sequence
  VP1__Norovirus__AHH44886
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 815 - protein, 539 aa, Artificial Sequence
  VP1__Norovirus__AHH44888
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 816 - protein, 539 aa, Artificial Sequence
  VP1__Norovirus__AHH44889
MKMASNDASPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEAGQNTKFTPVGIFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 817 - protein, 539 aa, Artificial Sequence; identical to SEQ ID NO: 815
  VP1__Norovirus__AHH44890

SEQ ID NO: 818 - protein, 539 aa, Artificial Sequence; identical to SEQ ID NO: 815
  VP1__Norovirus__AHH44891

SEQ ID NO: 819 - protein, 539 aa, Artificial Sequence; identical to SEQ ID NO: 815
  VP1__Norovirus__AHH44893

SEQ ID NO: 820 - protein, 539 aa, Artificial Sequence
  VP1__Norovirus__AHH44894
MKMASNDASPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGSIRFSTDTNNDFEASQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 821 - protein, 539 aa, Artificial Sequence
  VP1__Norovirus__AHH44895
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFTGTSEYAMNLASQNWDNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 822 - protein, 539 aa, Artificial Sequence; identical to SEQ ID NO: 815
  VP1__Norovirus__AHH44896

SEQ ID NO: 823 - protein, 539 aa, Artificial Sequence; identical to SEQ ID NO: 815
  VP1__Norovirus__AHH44897

SEQ ID NO: 824 - protein, 539 aa, Artificial Sequence; identical to SEQ ID NO: 815
  VP1__Norovirus__AHH44899

SEQ ID NO: 825 - protein, 539 aa, Artificial Sequence
  VP1__Norovirus__AHH44900
MKMASNDASPSDGSAANLVPEVNNEVMALEPVVGATIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVSPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 826 - protein, 539 aa, Artificial Sequence; identical to SEQ ID NO: 815
  VP1__Norovirus__AHH44902

SEQ ID NO: 827 - protein, 539 aa, Artificial Sequence
  VP1__Norovirus__AHH44904
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVSPTVESRSKPFTVPILTVEEMTNSRFPIPLEKLFTGPSGAFVVQPQNGRCTTDGVLLGTTQLSPVNICTFRGDLTHFTGTSEYAMNLASQNWNNYDPTEEIPAPLGAPDFVGKIRGMLTQTTRRDGSTRGHRATLSTGSAHFTPKLGNIRFSTDTNNDFEAGQNTKFTPVGVFQEGDNHQNEPQQWVLPNYSGATAHNVHLAPAVAPAFPGEQLLFFRSTMPGCGGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 828 - protein, 539 aa, Artificial Sequence; identical to SEQ ID NO: 815
  VP1__Norovirus__AHH44905

SEQ ID NO: 829 - protein, 539 aa, Artificial Sequence
  VP1__Norovirus__AHH44906
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTYSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 830 - protein, 539 aa, Artificial Sequence
  VP1__Norovirus__AHH44907
MKMASNDASPSDGSAANLVPEVNNEVMALEPVVGAAIAAPVAGQQNVIDPWIRNKFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRCAL

SEQ ID NO: 831 - protein, 539 aa, Artificial Sequence
  VP1__Norovirus__AHH44908
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 832 - protein, 539 aa, Artificial Sequence
  VP1__Norovirus__AHH44909
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAWEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 833 - protein, 539 aa, Artificial Sequence
  VP1__Norovirus__AHH44911
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWNNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 834 - protein, 539 aa, Artificial Sequence
  VP1__Norovirus__AHH44912
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSGAFVVQPQNGRCTTDGVLLGTTQLSPVNICTFRGDLTHFAGTHEYAMNLASQNWSNYDPTEEIPAPLGAPDFVGKIRGVLTQTTRGDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPDMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 835 - protein, 539 aa, Artificial Sequence
  VP1__Norovirus__AHH44913
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLTQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 836 - protein, 539 aa, Artificial Sequence
  VP1__Norovirus__AHH44914
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTHEYAMNLASQNWTNYDPTEEIPAPLGAPDFVGKIRGVLTQTTRGDGSTRGHRATLSTGSAHFTPKLGSVRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 837 - protein, 539 aa, Artificial Sequence
  VP1__Norovirus__AHH44915
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSKDPTIKLIAMLYTPLRANNAGEDVFTVSCRVLTRPSPDFDFIFLVPPTVESRSKPFTVPILTVEEMTNSRFPIPLEKLFTGPSSAFVVQPQNGRCTTDGVLLGTTQLSPVNICTFRGDLTHFAGTSEYAMNLASQNWTNYDPTEEIPAPLGAPDFVGKIRGVLTQTTRRDGSTRGHRATLSTGSAHFTPKLGSIRFSTDTNNDFEAGQNTKFTPVGVFQDGDNHQNEPQQWVLPNYSGATAHNVHLAPAVAPAFPGEQLLFFRSTMPGCSGYPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRRRAL

SEQ ID NO: 838 - protein, 540 aa, Artificial Sequence; identical to SEQ ID NO: 625
  VP1__Norovirus__AID60853

SEQ ID NO: 839 - protein, 540 aa, Artificial Sequence; identical to SEQ ID NO: 673
  VP1__Norovirus__AID60855

SEQ ID NO: 840 - protein, 540 aa, Artificial Sequence; identical to SEQ ID NO: 673
  VP1__Norovirus__AID60857

SEQ ID NO: 841 - protein, 540 aa, Artificial Sequence; identical to SEQ ID NO: 673
  VP1__Norovirus__AID60859

SEQ ID NO: 842 - protein, 540 aa, Artificial Sequence
  VP1__Norovirus__AID60861
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 843 - protein, 540 aa, Artificial Sequence
  VP1__Norovirus__AID60863
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 844 - protein, 540 aa, Artificial Sequence
  VP1__Norovirus__AID60865
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHVVIDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 845 - protein, 540 aa, Artificial Sequence
  VP1__Norovirus__AID60869
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTNGSTRGHKATVYAGSANFAPKLGRVQFETDTDHDLEANQNTKFTPVGVIQDGNTTHRNEPQQWVLPSYSGRSTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 846 - protein, 540 aa, Artificial Sequence
  VP1__Norovirus__AID60871
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 847 - protein, 540 aa, Artificial Sequence
  VP1__Norovirus__AID60875
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFESWVNQFYTLAPMGNGTGRRRAL

SEQ ID NO: 848 - protein, 540 aa, Artificial Sequence
  VP1__Norovirus__AID60877
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 849 - protein, 540 aa, Artificial Sequence; identical to SEQ ID NO: 848
  VP1__Norovirus__AID60879

SEQ ID NO: 850 - protein, 540 aa, Artificial Sequence
  VP1__Norovirus__AID60881
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 851 - protein, 540 aa, Artificial Sequence
  VP1__Norovirus__AID60883
MKMASSDANPSDGSAANLVPEVNNEVMALEPVVGAAIAAPVAGQQNVIDPWIRNNFVQAPGGEFTISPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDLIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 852 - protein, 540 aa, Artificial Sequence; identical to SEQ ID NO: 848
  VP1__Norovirus__AID60885

SEQ ID NO: 853 - protein, 540 aa, Artificial Sequence
  VP1__Norovirus__AID60887
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 854 - protein, 540 aa, Artificial Sequence
  VP1__Norovirus__AID60889
MKMASSDANPCDGSAANLVPEVNNEVMALEPVVGAAIAAPVGGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFETNQNTKFTPVGVIQDGSTTHRNEPQQWVLPSYSGRNTPNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 855 - protein, 540 aa, Artificial Sequence
  VP1__Norovirus__AID60893
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFETNQNTKFTPVGVIQDGSTTHRNEPQQWVLPSYSGRNTPNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 856 - protein, 540 aa, Artificial Sequence
  VP1__Norovirus__AID68577
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 857 - protein, 540 aa, Artificial Sequence
  VP1__Norovirus__AID68578
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFSPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 858 - protein, 540 aa, Artificial Sequence
  VP1__Norovirus__AID68579
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFSPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 859 - protein, 540 aa, Artificial Sequence; identical to SEQ ID NO: 681
  VP1__Norovirus__AID68581

SEQ ID NO: 860 - protein, 540 aa, Artificial Sequence
  VP1__Norovirus__AID69174
MRMASDDAKSAPSDLEGAGLVPATAAPLPVAPVAGAQAAEPFAGQINVIDPWIYTNFVQAPTGEFTVSPRNTPGEVLVNLEIGPNLNPYLQHLAQMYNGYAGGVEVQVILAGNAFTAGKLLCALVPPGFPTSSITPAQLTMLPHTIIDVRTTDPVVVPMPDVRRTLWHEVRSTTEPLMRLVIMLYTPMRANSGSDEAFVVSGRVLSRPAPDFNFFYLVPPRVEDTVEPFSLPDLRVDEMSSSRWQNPVVMLQADPNQNIAAHWQNGRCTINGELLGTTPRNQSWLLRMRGSVLAAPGGQKAVTVNVDLTEPDGQAFSVLSGNPGPEGVPDFQAIYNVRMSTASTTAGHTVATNGYIEQSGYTPALGTLVIQGVDLSQVPALGSEVTMQVVSIDLNHNMDPTRLPDYNGAGFDGSVALAPPLVPPLPGEVLLRFTTLPITTSRGSSVSATLDCALPAEWITWFLVHNFVPQGDAALLRYRNRGTGQILFECKLYKEGFLAVAGVSTRTVFPTSGVFEFVSWVPVFYQLTPVGSSGARKRQR

SEQ ID NO: 861 - protein, 540 aa, Artificial Sequence
  VP1__Norovirus__AIG59994
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYIGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 862 - protein, 540 aa, Artificial Sequence
  VP1__Norovirus__AIG59996
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 863 - protein, 540 aa, Artificial Sequence; identical to SEQ ID NO: 625
  VP1__Norovirus__AIG59998

SEQ ID NO: 864 - protein, 540 aa, Artificial Sequence
  VP1__Norovirus__AIG60000
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGHAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 865 - protein, 540 aa, Artificial Sequence
  VP1__Norovirus__AIG60002
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGAVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSIMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 866 - protein, 540 aa, Artificial Sequence; identical to SEQ ID NO: 625
  VP1__Norovirus__AIG60004

SEQ ID NO: 867 - protein, 540 aa, Artificial Sequence; identical to SEQ ID NO: 625
  VP1__Norovirus__AIG60006

SEQ ID NO: 868 - protein, 540 aa, Artificial Sequence
  VP1__Norovirus__AIG60008
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 869 - protein, 540 aa, Artificial Sequence; identical to SEQ ID NO: 679
  VP1__Norovirus__AIG60010

SEQ ID NO: 870 - protein, 540 aa, Artificial Sequence; identical to SEQ ID NO: 625
  VP1__Norovirus__AIG60012

SEQ ID NO: 871 - protein, 540 aa, Artificial Sequence
  VP1__Norovirus__AIG60014
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 872 - protein, 540 aa, Artificial Sequence; identical to SEQ ID NO: 673
  VP1__Norovirus__AIG60016

SEQ ID NO: 873 - protein, 540 aa, Artificial Sequence; identical to SEQ ID NO: 625
  VP1__Norovirus__AIG60018

SEQ ID NO: 874 - protein, 540 aa, Artificial Sequence
  VP1__Norovirus__AIG60020
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGIVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 875 - protein, 540 aa, Artificial Sequence; identical to SEQ ID NO: 625
  VP1__Norovirus__AIG60022

SEQ ID NO: 876 - protein, 540 aa, Artificial Sequence; identical to SEQ ID NO: 679
  VP1__Norovirus__AIG60024

SEQ ID NO: 877 - protein, 542 aa, Artificial Sequence
  VP1__Norovirus__AII73717
MKMASNDAAPSNDGAASLVPEGINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNETNVVQCQNGRCTLDGELQGTTQLLSSAVCSYRGRTVANNGDNWDQNLLQLTYPNGASYDPTDEVPAPLGTQDFSGMLYGVLTQDNVNVSTGEAKNAKGIYISTTSGKFTPKIGSIGLHSITEHVHPNQQSRFTPVGVAVNENTPFQQWVLPHYAGSLALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRIQ

SEQ ID NO: 878 - protein, 540 aa, Artificial Sequence
  VP1__Norovirus__AII73720
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIVDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 879 - protein, 536 aa, Artificial Sequence
  VP1__Norovirus__AII73723
MKMASNDATPSDDGAAGLVPEINSEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAVLYGVASQRSSRDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 880 - protein, 540 aa, Artificial Sequence; identical to SEQ ID NO: 625
  VP1__Norovirus__AII73726

SEQ ID NO: 881 - protein, 540 aa, Artificial Sequence; identical to SEQ ID NO: 625
  VP1__Norovirus__AII73729

SEQ ID NO: 882 - protein, 540 aa, Artificial Sequence; identical to SEQ ID NO: 625
  VP1__Norovirus__AII73732

SEQ ID NO: 883 - protein, 535 aa, Artificial Sequence
  VP1__Norovirus__AII73735
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSPRDHDNACRSHDAVIATNSAKFTPKLGAIQIGTWEENDVHINQPTKFTPVGLFEDEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 884 - protein, 540 aa, Artificial Sequence; identical to SEQ ID NO: 679
  VP1__Norovirus__AII73738

SEQ ID NO: 885 - protein, 539 aa, Artificial Sequence
  VP1__Norovirus__AII73741
MKMASNDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADIVVQPQNGRCTLDGELQGTTQLLTTAICSYRGMTSNPTSDYWDDHLLHLVHPNGATYDPTEDVPAPFGTQDFRGILYGMLTQNPRTSGDEAANSHGIYISSTSEKFTPKLGTIGLHQVQGDIASNQQSKFTPVGIAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRVQ

SEQ ID NO: 886 - protein, 540 aa, Artificial Sequence; identical to SEQ ID NO: 22
  VP1__Norovirus__AII73744

SEQ ID NO: 887 - protein, 540 aa, Artificial Sequence
  VP1__Norovirus__AII73747
MKMASNDAAPSNDGATGLVPEINNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPANRMRLVAMLYTPLRSNGSGDDVFTVSCRVLTRPTPDFEFTYLVPPSVESKTKPFSLPILTISELTNSRFPAPIDSLFTAQNNNLNVQCQNGRCTLDGELQGTTQLLPSGICAFRGRLTADVDGSHDDRWHMQLTNLNGTPFDPTEDVPAPLGTPDFTGLLFGVASQRNVGSNPNTTRAHEAVISTTSSQFVPKLGSVNFGSTSTDFQLQQPTKFTPVGIKIESGHEFDQWALPRYSGHLTLNMNLAPPIAPNFPGEQLLFFRSNVPCAGGVSDGVIDCLLPQEWIQHFYQESAPSQSDVALIRYVNPDTGRTLFEAKLHRTGYITVAHSGDYPLVVPSNGYFRFDSWVNQFYSLAPMGTGNGRRRVQ

SEQ ID NO: 888 - protein, 540 aa, Artificial Sequence
  VP1__Norovirus__AII73750
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 889 - protein, 540 aa, Artificial Sequence
  VP1__Norovirus__AII73753
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLQITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 890 - protein, 540 aa, Artificial Sequence; identical to SEQ ID NO: 22
  VP1__Norovirus__AII73756

SEQ ID NO: 891 - protein, 555 aa, Artificial Sequence
  VP1__Norovirus__AII73759
MRMASSDAPVSGTDGAAGLVPESQQEVLPLEPVAGVQLAAPVAGQSNIIDPWIRMNFVQAPAGEFTVSPRNAPGEVLIDLELGPELNPYLNHLARMYNGYVGGMEVEVVLAGNAFTAGKILFAAVPPSFPTHGISAAQATMLPHVIVDVRQLEPVRLPLPDVRNVMFHFCQENKEPRMRIVAILYTPLRANGAGDDVFTVSCRVLTRPSPDFDFIFLVPPSVESKLKQFTLPNLQPNEMTNSRFPTGITQLYTSPNTNLVVQFQNGRCLLDGTLLGTTPVRAADICSFRGVTSTEVDATDSPRVAGSHRIMVQLREPDGEEFSPTGPNPAPVGTPDFQAAIFGTLSQRNTGGAGQNSNRAHFAYFYTRNPTFAPGIGTVVFSFDTTDFQNRQPTKFSPSGVFDDDSSEPFNQFSLPYYNGSLGAVDAGKLAPPVAPNYPGEQILYFRGSVPFKGGYGEGEIDSLLPQEWITHFYAEQAPTQGDAALLRYYNPDTGRVLFECKLHREGFITINYTGSNALAVPVNGVFRFEGWVNKFYTLTPMGNGNGRRGRRREL

SEQ ID NO: 892 - protein, 555 aa, Artificial Sequence
  VP1__Norovirus__AII73762
MKMASKDASPSTDGTANLVPESQQEVLALQPVAGAQIAAPVAGQFNVIDPWIYQNFVQAPEGEFTVSPRNSTGEILMNLELGPQLNPYLAHLARMYNAYAGGFEVQVLLAGNAFTAGKIIVCAVPPNFPLQNISAAQATQLPHVVVDVRQLEPVVLPLPDVRAGFYHYNQVEESRMRLVAILYTPLRTNSAGDDAFTVSCRILTRPAPDFSFFFLIPPTIESKTTPFTLPRLPISEMTNSRFPLVIKGMVVDPNLPLQANFQNGRITLDGELQGTTLPTSTSIGRISGTHMSSTPSRIIQHEDSGDSTQPRVFNPVWMDLTENNWTEFQPFNDQPAPLGCPDFKAKILGTLIRQPNNGSYYFDAYLDTRQHGTFAPYTGHAAVHSDQQAGHLAQGYKIQFSPTGIESDQNTDLNQLPDYGGAMTVSKGLAPAAAPDFPGEMILYFVSDMPVRNPNGERRDTEILCLLPQEMVTHFYEQQAPSQGDVALVRYINAETGRVMFEGKLHRNGFFTVSATARTLIVPDGYFRFDSWVNRFYTLSPMGTGNGRRRARMLE

SEQ ID NO: 893 - protein, 545 aa, Artificial Sequence
  VP1__Norovirus__AII73765
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFVAQNVSIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLGWVSPVSDGHKGDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRLGIRRS

SEQ ID NO: 894 - protein, 540 aa, Artificial Sequence; identical to SEQ ID NO: 625
  VP1__Norovirus__AII73768

SEQ ID NO: 895 - protein, 535 aa, Artificial Sequence
  VP1__Norovirus__AII73771
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGILVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEQDDVHINQPTKFTPVGLFENEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 896 - protein, 540 aa, Artificial Sequence
  VP1__Norovirus__AII73774
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLIAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEANINTGGDQYAPKLAQVKFFSESQDFEVHQPTVFTPVGVAGDTSHPFRQWVLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRIQ

SEQ ID NO: 897 - protein, 540 aa, Artificial Sequence
  VP1__Norovirus__AII73777
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQYDLVIPPNGYFRFDSWVNQFYTLAPMGNGTGRRRAV

SEQ ID NO: 898 - protein, 536 aa, Artificial Sequence
  VP1__Norovirus__AII73780
MKMASNDATPSDDGAAGLVPEINSEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENTIVQPQNGRCTTDGELLGTTILQSVSICNFKGTMQAKLNEEPRYQLQLTNLDGSPIDPTDDMPAPLGTPDFQAVLYGVASQRSSRDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 899 - protein, 543 aa, Artificial Sequence
  VP1__Norovirus__AII73783
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQGTTTVSAACVARMRGRIFNNNGNYGVNLTELDGNPYHAFDSPAPLGFPDFGNCDLHMTFVKINPNELSSGDPSGKVVIHSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRLGLRRS

SEQ ID NO: 900 - protein, 535 aa, Artificial Sequence
  VP1__Norovirus__AII73786
MKMASSDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEENDVHINQPTKFTPVGLFEDEGFNQWTLPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 901 - protein, 540 aa, Artificial Sequence
  VP1__Norovirus__AIS40019
MKMASSDANPSDGSAANLVPEVNNEVMALEPVVGAAIAAPVAGQQNVIDPWIRNNFVPAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGATQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 902 - protein, 540 aa, Artificial Sequence; identical to SEQ ID NO: 673
  VP1__Norovirus__AIV43147

SEQ ID NO: 903 - protein, 540 aa, Artificial Sequence; identical to SEQ ID NO: 677
  VP1__Norovirus__AIV43148

SEQ ID NO: 904 - protein, 540 aa, Artificial Sequence; identical to SEQ ID NO: 677
  VP1__Norovirus__AIV43149

SEQ ID NO: 905 - protein, 540 aa, Artificial Sequence
  VP1__Norovirus__AIV43150
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 906 - protein, 540 aa, Artificial Sequence
  VP1__Norovirus__AIV43151
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 907 - protein, 540 aa, Artificial Sequence; identical to SEQ ID NO: 673
  VP1__Norovirus__AIV43152

SEQ ID NO: 908 - protein, 540 aa, Artificial Sequence; identical to SEQ ID NO: 673
  VP1__Norovirus__AIV43153

SEQ ID NO: 909 - protein, 540 aa, Artificial Sequence; identical to SEQ ID NO: 673
  VP1__Norovirus__AIV43154

SEQ ID NO: 910 - protein, 540 aa, Artificial Sequence; identical to SEQ ID NO: 625
  VP1__Norovirus__AIV43155

SEQ ID NO: 911 - protein, 540 aa, Artificial Sequence
  VP1__Norovirus__AIV43156
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLARPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTKTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 912 - protein, 540 aa, Artificial Sequence
  VP1__Norovirus__AIV43159
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLARPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 913 - protein, 540 aa, Artificial Sequence
  VP1__Norovirus__AIV43160
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 914 - protein, 540 aa, Artificial Sequence; identical to SEQ ID NO: 913
  VP1__Norovirus__AIV43161

SEQ ID NO: 915 - protein, 540 aa, Artificial Sequence; identical to SEQ ID NO: 673
  VP1__Norovirus__AIV43162

SEQ ID NO: 916 - protein, 540 aa, Artificial Sequence; identical to SEQ ID NO: 673
  VP1__Norovirus__AIV43163

SEQ ID NO: 917 - protein, 540 aa, Artificial Sequence; identical to SEQ ID NO: 913
  VP1__Norovirus__AIV43164

SEQ ID NO: 918 - protein, 540 aa, Artificial Sequence
  VP1__Norovirus__AIV43165
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 919 - protein, 540 aa, Artificial Sequence
  VP1__Norovirus__AIV43166
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 920 - protein, 540 aa, Artificial Sequence
  VP1__Norovirus__AIV43167
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 921 - protein, 540 aa, Artificial Sequence
  VP1__Norovirus__AIV43171
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 922 - protein, 540 aa, Artificial Sequence
  VP1__Norovirus__AIV43172
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 923 - protein, 540 aa, Artificial Sequence
  VP1__Norovirus__AIV43173
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 924 - protein, 540 aa, Artificial Sequence
  VP1__Norovirus__AIV43174
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 925 - protein, 540 aa, Artificial Sequence; identical to SEQ ID NO: 924
  VP1__Norovirus__AIV43175

SEQ ID NO: 926 - protein, 540 aa, Artificial Sequence; identical to SEQ ID NO: 673
  VP1__Norovirus__AIV43176

SEQ ID NO: 927 - protein, 540 aa, Artificial Sequence; identical to SEQ ID NO: 868
  VP1__Norovirus__AIV43177

SEQ ID NO: 928 - protein, 540 aa, Artificial Sequence; identical to SEQ ID NO: 922
  VP1__Norovirus__AIV43178

SEQ ID NO: 929 - protein, 540 aa, Artificial Sequence
  VP1__Norovirus__AIV43179
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEDIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 930 - protein, 540 aa, Artificial Sequence
  VP1__Norovirus__AIY27747
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 931 - protein, 540 aa, Artificial Sequence; identical to SEQ ID NO: 924
  VP1__Norovirus__AJA71387

SEQ ID NO: 932 - protein, 540 aa, Artificial Sequence
  VP1__Norovirus__AJA71388
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 933 - protein, 540 aa, Artificial Sequence; identical to SEQ ID NO: 922
  VP1__Norovirus__AJA71389

SEQ ID NO: 934 - protein, 540 aa, Artificial Sequence
  VP1__Norovirus__AJA71390
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGLLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 935 - protein, 540 aa, Artificial Sequence; identical to SEQ ID NO: 673
  VP1__Norovirus__AJA71392

SEQ ID NO: 936 - protein, 540 aa, Artificial Sequence; identical to SEQ ID NO: 677
  VP1__Norovirus__AJA71393

SEQ ID NO: 937 - protein, 540 aa, Artificial Sequence
  VP1__Norovirus__AJA71394
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYIGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSRVNQFYTLAPMGNGTGRRRAL

SEQ ID NO: 938 - protein, 540 aa, Artificial Sequence; identical to SEQ ID NO: 868
  VP1__Norovirus__AJA71395

SEQ ID NO: 939 - protein, 540 aa, Artificial Sequence
  VP1__Norovirus__AJA71396
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRRAL

SEQ ID NO: 940 - protein, 540 aa, Artificial Sequence
  VP1__Norovirus__AJA71399
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIAVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 941 - protein, 540 aa, Artificial Sequence
  VP1__Norovirus__AJA71400
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 942 - protein, 540 aa, Artificial Sequence
  VP1__Norovirus__AJA71401
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWSNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 943 - protein, 540 aa, Artificial Sequence; identical to SEQ ID NO: 677
  VP1__Norovirus__AJA71402

SEQ ID NO: 944 - protein, 540 aa, Artificial Sequence
  VP1__Norovirus__AJA71403
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTIESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 945 - protein, 540 aa, Artificial Sequence; identical to SEQ ID NO: 941
  VP1__Norovirus__AJA71404

SEQ ID NO: 946 - protein, 540 aa, Artificial Sequence
  VP1__Norovirus__AJA71405
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGIPDFVGKIQGMLTQTTRTDGSTRGHKATVYTGSVDFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 947 - protein, 540 aa, Artificial Sequence
  VP1__Norovirus__AJA71406
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 948 - protein, 540 aa, Artificial Sequence
  VP1__Norovirus__AJA71407
MKMASSDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 949 - protein, 540 aa, Artificial Sequence; identical to SEQ ID NO: 944
  VP1__Norovirus__AJA71408

SEQ ID NO: 950 - protein, 540 aa, Artificial Sequence; identical to SEQ ID NO: 941
  VP1__Norovirus__AJA71409

SEQ ID NO: 951 - protein, 540 aa, Artificial Sequence
  VP1__Norovirus__AJA71410
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 952 - protein, 540 aa, Artificial Sequence; identical to SEQ ID NO: 868
  VP1__Norovirus__AJA71411

SEQ ID NO: 953 - protein, 540 aa, Artificial Sequence
  VP1__Norovirus__AJA71412
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRRAL

SEQ ID NO: 954 - protein, 540 aa, Artificial Sequence; identical to SEQ ID NO: 673
  VP1__Norovirus__AJA71413

SEQ ID NO: 955 - protein, 540 aa, Artificial Sequence; identical to SEQ ID NO: 625
  VP1__Norovirus__AJA71416

SEQ ID NO: 956 - protein, 540 aa, Artificial Sequence
  VP1__Norovirus__AJA71417
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLTSQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 957 - protein, 540 aa, Artificial Sequence
  VP1__Norovirus__AJA71418
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 958 - protein, 540 aa, Artificial Sequence; identical to SEQ ID NO: 957
  VP1__Norovirus__AJA71419

SEQ ID NO: 959 - protein, 540 aa, Artificial Sequence; identical to SEQ ID NO: 673
  VP1__Norovirus__AJA71420

SEQ ID NO: 960 - protein, 540 aa, Artificial Sequence; identical to SEQ ID NO: 868
  VP1__Norovirus__AJA71421

SEQ ID NO: 961 - protein, 540 aa, Artificial Sequence; identical to SEQ ID NO: 944
  VP1__Norovirus__AJA71422

SEQ ID NO: 962 - protein, 540 aa, Artificial Sequence
  VP1__Norovirus__AJA71423
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYIGGADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 963 - protein, 540 aa, Artificial Sequence
  VP1__Norovirus__AJA71424
MKMASSDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRAL

SEQ ID NO: 964 - protein, 540 aa, Artificial Sequence
  VP1__Norovirus__AJA71425
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 965 - protein, 540 aa, Artificial Sequence
  VP1__Norovirus__AJA71426
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSSYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 966 - protein, 540 aa, Artificial Sequence
  VP1__Norovirus__AJA71427
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWGNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 967 - protein, 540 aa, Artificial Sequence; identical to SEQ ID NO: 951
  VP1__Norovirus__AJA71428

SEQ ID NO: 968 - protein, 540 aa, Artificial Sequence
  VP1__Norovirus__AJA71429
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFIVQPQNGRCTTDGVLLGTTQLSPVNICTFRGDVTHISGSRNYTMNLASQNWNSYDPTEETPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRRVL

SEQ ID NO: 969 - protein, 540 aa, Artificial Sequence
  VP1__Norovirus__AJA71430
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFDANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 970 - protein, 540 aa, Artificial Sequence
  VP1__Norovirus__AJA71456
MKMASSDANPSDGSAANLVPEVNNEVMALEPVVGATIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 971 - protein, 540 aa, Artificial Sequence
  VP1__Norovirus__AJA71457
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPSMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 972 - protein, 540 aa, Artificial Sequence
  VP1__Norovirus__AJA71458
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPAEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 973 - protein, 540 aa, Artificial Sequence
  VP1__Norovirus__AJA71459
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSVDFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 974 - protein, 540 aa, Artificial Sequence; identical to SEQ ID NO: 944
  VP1__Norovirus__AJA71460

SEQ ID NO: 975 - protein, 540 aa, Artificial Sequence; identical to SEQ ID NO: 673
  VP1__Norovirus__AJA71461

SEQ ID NO: 976 - protein, 540 aa, Artificial Sequence; identical to SEQ ID NO: 947
  VP1__Norovirus__AJA71462

SEQ ID NO: 977 - protein, 540 aa, Artificial Sequence; identical to SEQ ID NO: 957
  VP1__Norovirus__AJA71463

SEQ ID NO: 978 - protein, 540 aa, Artificial Sequence; identical to SEQ ID NO: 951
  VP1__Norovirus__AJA71464

SEQ ID NO: 979 - protein, 540 aa, Artificial Sequence; identical to SEQ ID NO: 951
  VP1__Norovirus__AJA71465

SEQ ID NO: 980 - protein, 540 aa, Artificial Sequence
  VP1__Norovirus__AJA71466
MKMASSDANPSDGSAANLVPEVNNEVMALEPVVGAAIAAPVAGQQNVIDPWIRNNLVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 981 - protein, 540 aa, Artificial Sequence
  VP1__Norovirus__AJA71467
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTRFTPVGVIQDGGTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 982 - protein, 540 aa, Artificial Sequence
  VP1__Norovirus__AJA71470
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 983 - protein, 540 aa, Artificial Sequence
  VP1__Norovirus__AJA71471
MKMASSDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNRDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 984 - protein, 540 aa, Artificial Sequence
  VP1__Norovirus__AJA71472
MKMASSDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 985 - protein, 540 aa, Artificial Sequence
  VP1__Norovirus__AJA71473
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 986 - protein, 540 aa, Artificial Sequence
  VP1__Norovirus__AJA71474
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNTDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 987 - protein, 540 aa, Artificial Sequence; identical to SEQ ID NO: 868
  VP1__Norovirus__AJA71475

SEQ ID NO: 988 - protein, 540 aa, Artificial Sequence; identical to SEQ ID NO: 947
  VP1__Norovirus__AJA71476

SEQ ID NO: 989 - protein, 540 aa, Artificial Sequence
  VP1__Norovirus__AJF21974
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 990 - protein, 540 aa, Artificial Sequence
  VP1__Norovirus__AJF21975
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 991 - protein, 540 aa, Artificial Sequence; identical to SEQ ID NO: 922
  VP1__Norovirus__AJF21976

SEQ ID NO: 992 - protein, 540 aa, Artificial Sequence
  VP1__Norovirus__AJF21977
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 993 - protein, 540 aa, Artificial Sequence
  VP1__Norovirus__AJF21978
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNTDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 994 - protein, 540 aa, Artificial Sequence
  VP1__Norovirus__AJF21979
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 995 - protein, 540 aa, Artificial Sequence
  VP1__Norovirus__AJF21980
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 996 - protein, 540 aa, Artificial Sequence; identical to SEQ ID NO: 982
  VP1__Norovirus__AJF21981

SEQ ID NO: 997 - protein, 540 aa, Artificial Sequence; identical to SEQ ID NO: 951
  VP1__Norovirus__AJF21982

SEQ ID NO: 998 - protein, 540 aa, Artificial Sequence
  VP1__Norovirus__AJF21983
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDRDFEANQNTKFTPVGVIQDGGTTHRNEPQQWVLPSYSGRNAPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 999 - protein, 540 aa, Artificial Sequence
  VP1__Norovirus__AJF21984
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1000 - protein, 540 aa, Artificial Sequence
  VP1__Norovirus__AKE37037
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 1001 - protein, 543 aa, Artificial Sequence
  VP1__Norovirus__AKM20815
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQGTTTVSAACVARMRGRIFNNNGNYGVNLTELDGNPYHAFDSPAPLGFPDFGNCDLHMTFVKINPNELSSGDPSGKVVIRSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRLGLRRS

SEQ ID NO: 1002 - protein, 540 aa, Artificial Sequence
  vp1__Norovirus__AKM20818
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFSFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 1003 - protein, 540 aa, Artificial Sequence
  VP1__Norovirus__ALD83748
MKMASNDAAPSNDGATGLVPEVNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPTNRMRLVAMLYTPLRSNGSGDDVFTVSCRVLTRPTPDFEFTYLVPPSVESKTKPFSLPILTISELTNSRFPVPVDSLFTAQNNNLNVQCQNGRCTLDGELQGTTQLQPSGICAFRGKITADVRPNHDDRWHMQLTNLNGTPFDPTEDVPAPLGTPDFTGLLFGVASQRNVQPNPNTTRAHEAVISTTSSQFVPKLGSINFGSTSEDFIVGQPTKFTPVGIKIEDGHAFDQWTLPRYSGHLTLNMNLAPPVAPNFPGEQLLFFRSNVPCAGGISDGVIDCLLPQEWIQHFYQESAPSQSDVALIRYVNPDTGRTLFEAKLHRTGYITVAHSGDYPLVVPSNGYFRFDSWVNQFYSLAPMGTGNGRRRVQ

SEQ ID NO: 1004 - protein, 540 aa, Artificial Sequence
  VP1__Norovirus__ALF12528
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSADSSPKLGRVQFATDTDNDFVANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTQAHTGQHDLVIPPNGYFRFDSWVNQFYTLAPMGNGTGRRRAL

SEQ ID NO: 1005 - protein, 540 aa, Artificial Sequence
  VP1__Norovirus__ALF12529
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNHFYTLAPVGNGTGRRRAL

SEQ ID NO: 1006 - protein, 540 aa, Artificial Sequence
  VP1__Norovirus__ALF12530
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRADGSTRGHKATVYTGSADFSPKLGRVQFATDTNNDFDANQNTKFTPVGVIQDGETAHRNEPQQWVLPSYSGRNIHNVHLAPAVAPTFPGEQLLFFRSTMPGCSGYPNMELDCLIPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1007 - protein, 540 aa, Artificial Sequence
  VP1__Norovirus__ALF12531
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLETPDFVGKIQGVLTQTTRTDGSTRGHKATVYTGSADFSPKLGRVQFATDTDNDFDSNQNTKFTPVGVIQDGGTTHRNEPQQWVLPSYSGRDIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVL

SEQ ID NO: 1008 - protein, 540 aa, Artificial Sequence
  VP1__Norovirus__ALF12532
MKMASSDANPSDGSTANLVPEVNNEVMALEPVVGAAIAAPVAGQQNAIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1009 - protein, 540 aa, Artificial Sequence
  VP1__Norovirus__ALF12533
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKITFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSHNYTMNLASQNWSSYDPTEEIPAPLGTPDFVGKIQGVLTQTTRTDGSTRGHKATVFTGSADFSPKLGRVQFATDTDNDFVANQNTKFTPVGVIQDGGTAHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1010 - protein, 540 aa, Artificial Sequence
  VP1__Norovirus__ALF12534
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFFSLAPMGNGTGRRRAL

SEQ ID NO: 1011 - protein, 540 aa, Artificial Sequence
  VP1__Norovirus__ALF12535
MKMASSDANPSVGSAANLVPEVNNEVMALEPVVGAAIAAPVAGQQNVIDPWIRNNFVQAPGGEFTVSPRNAPGEILWSAPLGPDLNPYLSHLARMYNGYAGGFEVLVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTTGSHNYTMNLATQNWNSYDPTEEIPAPLGTPDFVGKIQGVLTQTTKTDGSTRGHKATVYTGSADFAPKLGRVQFATDTDNDFEANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRRAL

SEQ ID NO: 1012 - protein, 540 aa, Artificial Sequence
  VP1__Norovirus__ALF12536
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTTGSHNYTMNLATQNWSSYDPTEEIPAPLGTPDFVGKIQGVLTQTTKTDGSTRGHKATVYTGSADFAPKLGRVQFATDTDNDFEANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRRAL

SEQ ID NO: 1013 - protein, 540 aa, Artificial Sequence
  VP1__Norovirus__ALF12537
MKMASSDANPSDGSTANLAPEVNNEVMALEPVVGAAIAAPVAGQKNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSAPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQRDLVIPPNGYFRFDSWVNQFYSLAPMGNGTGRRRAL

SEQ ID NO: 1014 - protein, 540 aa, Artificial Sequence
  VP1__Norovirus__ALF12538
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCSTDGVLLGTTQLSPVNICTFRGDVTHIAGSHNYTMNLASQNWSSYDPTEEIPAPLGTPDFVGKIQGVLTQTTRSDGSTRGHKATVYTGSADFSPKLGRVQFATDTDNDFVSNQNTKFTPVGVIQDGDTAHRNEPQQWVLPSYSGRNIHNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNHFYTLAPMGNGTGRRRVL

SEQ ID NO: 1015 - protein, 540 aa, Artificial Sequence
  VP1__Norovirus__ALF12539
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPRIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCSTDGVLLGTTQLSPVNICTFRGDVTHIAGSHNYTMNLASQNWSSYDPTEEIPAPLGTPDFVGKIQGVLTQTTRTDGSTRGHKATVYTGSADFSPKLGRVQFATDTNNDFESNQNTKFAPVGVIQDGGTAHRNEPQQWVLPSYSGRNIHNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1016 - protein, 540 aa, Artificial Sequence
  VP1__Norovirus__ALF12541
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILVGNAFTAGKIIFAAVPPNFPTEGLSPSQVTMFPHIIVDVRQLEPVLIPLPDVRNNFYHYNQSSDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSTDFTPKLGRAQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1017 - protein, 540 aa, Artificial Sequence
  VP1__Norovirus__ALF12542
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1018 - protein, 540 aa, Artificial Sequence
  VP1__Norovirus__ALF12543
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNCDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1019 - protein, 540 aa, Artificial Sequence
  VP1__Norovirus__ALF12546
MKMASSDANPSEGSTASLVPEVNNEVMALEPVAGAAIAAPVAGQVNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNEPTIKLVAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHISGSRNHTMNLASQNWNSYDPTEEIPAPLGTPDFVGKIQGVLTQTTRSDGSTRGHKATVYTGSADFSPKLGRIQFATDTDNDFETNQNTKFTPVGVIQDGGTTHRNEPQQWVLPTYSGRNTHNVHLAPAVAPTFPGEQLLFFRSTMPGCSGYPDMDLDCLLPQEWVQHFYQEAAPAQSDVALLRFVNPDTGRVLFECKLHKAGYVTVAHTGQHDLVIPPNGYFRFDSWVNQFFTLAPMGNGTGRRRAL

SEQ ID NO: 1020 - protein, 540 aa, Artificial Sequence
  VP1__Norovirus__ALF12547
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRSAHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1021 - protein, 540 aa, Artificial Sequence
  VP1__Norovirus__ALF12560
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANSAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICSFRGDVTHIAGSRNYTMNLASQNWNSYDPTEEIPAPLGTPDFVGKIQGVLTQTTRTDGSTRGHRATVYTGSADFSPKLGRVQFATDTDNDFVANQNTKFTPVGVIQDGDTAHRNEPQQWVLPSYSGRNIHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1022 - protein, 540 aa, Artificial Sequence
  VP1__Norovirus__ALF12562
MKMASSDANPSDGSTANLVPEVNNEVMALEPVVGAAIAAPVAGQQNVIDPWIRNNFVQAPGGEFTVSPRNAPGEILWSTPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1023 - protein, 540 aa, Artificial Sequence
  VP1__Norovirus__ALF12564
MKMASSDANSSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTKTDGSTRGHKATVYTGSADFAPKLGRVQFATDTDNDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRRAT

SEQ ID NO: 1024 - protein, 540 aa, Artificial Sequence
  VP1__Norovirus__ALF12566
MKMASSDANPSDGSAANLVPEVNNEVMALEPVVGAAIAAPVAGQQNVIDPWIRDNFVQAPGGEFTVSPRNAPGEILWSAPLGPDLNPYLSHLARMYNGYAGGFEVQVILAGNAFTAGKVIFAAVPPNFPTEGLSPSQVTMFPHMIVDVRQLEPVLIPLPDVRNNFYHYNQSNDPTLKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRIV

SEQ ID NO: 1025 - protein, 540 aa, Artificial Sequence
  VP1__Norovirus__ALF12569
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLPFFRSTMPGCSGYPNMDLDCLLPQEWVQYFYQEAAPAQSDVALLRFVNPDTGRVLFECKLHKSGYVTVAHTGQHDLVIPPYGYFRFDSWVNQFYTLAPMGNGTGRRRAL

SEQ ID NO: 1026 - protein, 540 aa, Artificial Sequence; identical to SEQ ID NO: 1000
  VP1__Norovirus__ALQ28762

SEQ ID NO: 1027 - protein, 543 aa, Artificial Sequence
  VP1__Norovirus__ALS03883
MKMASNDAAPSNDGAAGLVPEINNETMALEPVAGGAIAAPLTGQTNFIDPWIRGNYVQAPNGEFTVSPRNSPGEILLNLELGPELNPFLSHLSRMYNGYAGGIDVQVIMAGNAFTAGKIIFAAIPPHFPVENLSPPQITMFPHIIVDVRTLEPINIPVPDVRNNFFHYNQNNESRMRLVAMLYTPLRSNGSAEDVFTVSCRVLTKPSADFEFNYLVPPTVESRTKPFTIPILTIGEMTNSRFPVPIDMLHTSPTENIVVQPQNGRCTIDGELLGTTQLITSNICSFRGSISGHEGNDDQHLWHFNITNPNGTPFDPTEDVPAPLGTPDFRGQLYGVISQRDREGTPSENNQKANRSHQGVISTISPKFVPKLGSVMIGTWTTDDIKNQPSKFTPIGLNDDDNFKQWELPNYSGALTLNMGLAPSVFPTYPGEQILFFRSYLPLKGGYGSPFIDCLVPQEWVAHFYQESAPAQTDVALIRYVNPETGRVLFEAKLHRQGFITVAKSGDSPINVPANGYFRFDSWVNQFYSLAPMGTGNGRRRIQ

SEQ ID NO: 1028 - protein, 538 aa, Artificial Sequence
  VP1__Norovirus__ALT06546
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGMASQRNVGNDAPGSTRAHEAVISTYSPQFVPKLGSVNFRSNDNDFQLQPTKFTPVGINDDGDHPFRQWELPDYSGPLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 1029 - protein, 548 aa, Artificial Sequence
  VP1__Norovirus__BAG30939
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSARQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFMGVLTRSTSRASDQADTATPRLFNYYWHIQLDNPNGTPYDPAEDIPGPLGTPDFRGKVFGVASQRNPDSTTRAHEAKVDTTAGRFTPKLGSLEISTESDDFHQNQPTRFTPVGIGVDNEADFQQWSLPDYSGQFTHNMNLAPAVAPNFPGEQLLFFRSQLPSSGGRSNGILDCLVPQEWVQHFYQESAPSQTQVALVRYVNPDTGRVLFEAKLHKLGFMTIAKNGDSPITVPPNGYFRFESWVNPFYTLAPMGTGNGRRRIQ

SEQ ID NO: 1030 - protein, 540 aa, Artificial Sequence; identical to SEQ ID NO: 472
  VP1__Norovirus__BAG70428

SEQ ID NO: 1031 - protein, 540 aa, Artificial Sequence; identical to SEQ ID NO: 472
  VP1__Norovirus__BAG70431

SEQ ID NO: 1032 - protein, 540 aa, Artificial Sequence
  VP1__Norovirus__BAG70434
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1033 - protein, 540 aa, Artificial Sequence
  VP1__Norovirus__BAG70437
MKMASNDANPSDGSTANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAKVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1034 - protein, 540 aa, Artificial Sequence
  VP1__Norovirus__BAG70440
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRRAL

SEQ ID NO: 1035 - protein, 540 aa, Artificial Sequence
  VP1__Norovirus__BAG70446
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1036 - protein, 540 aa, Artificial Sequence
  VP1__Norovirus__BAG70449
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1037 - protein, 540 aa, Artificial Sequence
  VP1__Norovirus__BAG70452
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1038 - protein, 540 aa, Artificial Sequence; identical to SEQ ID NO: 342
  VP1__Norovirus__BAG70458

SEQ ID NO: 1039 - protein, 540 aa, Artificial Sequence; identical to SEQ ID NO: 20
  VP1__Norovirus__BAG70461

SEQ ID NO: 1040 - protein, 540 aa, Artificial Sequence; identical to SEQ ID NO: 20
  VP1__Norovirus__BAG70464

SEQ ID NO: 1041 - protein, 540 aa, Artificial Sequence; identical to SEQ ID NO: 20
  VP1__Norovirus__BAG70467

SEQ ID NO: 1042 - protein, 540 aa, Artificial Sequence; identical to SEQ ID NO: 472
  VP1__Norovirus__BAG70470

SEQ ID NO: 1043 - protein, 540 aa, Artificial Sequence; identical to SEQ ID NO: 472
  VP1__Norovirus__BAG70473

SEQ ID NO: 1044 - protein, 540 aa, Artificial Sequence
  VP1__Norovirus__BAG70476
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEELPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1045 - protein, 540 aa, Artificial Sequence
  VP1__Norovirus__BAG70482
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTDGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1046 - protein, 540 aa, Artificial Sequence; identical to SEQ ID NO: 20
  VP1__Norovirus__BAG70485

SEQ ID NO: 1047 - protein, 540 aa, Artificial Sequence; identical to SEQ ID NO: 20
  VP1__Norovirus__BAG70488

SEQ ID NO: 1048 - protein, 540 aa, Artificial Sequence
  VP1__Norovirus__BAG70491
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTAHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1049 - protein, 540 aa, Artificial Sequence
  VP1__Norovirus__BAG70494
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNHFYTLAPMGNGTGRRRAL

SEQ ID NO: 1050 - protein, 540 aa, Artificial Sequence; identical to SEQ ID NO: 342
  VP1__Norovirus__BAG70497

SEQ ID NO: 1051 - protein, 540 aa, Artificial Sequence; identical to SEQ ID NO: 512
  VP1__Norovirus__BAG70503

SEQ ID NO: 1052 - protein, 540 aa, Artificial Sequence; identical to SEQ ID NO: 342
  VP1__Norovirus__BAG70506

SEQ ID NO: 1053 - protein, 540 aa, Artificial Sequence
  VP1__Norovirus__BAG70509
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1054 - protein, 540 aa, Artificial Sequence
  VP1__Norovirus__BAG70512
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLSWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 1055 - protein, 540 aa, Artificial Sequence
  VP1__Norovirus__BAG70515
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1056 - protein, 540 aa, Artificial Sequence; identical to SEQ ID NO: 1055
  VP1__Norovirus__BAG70518

SEQ ID NO: 1057 - protein, 540 aa, Artificial Sequence
  VP1__Norovirus__BAG70521
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1058 - protein, 540 aa, Artificial Sequence
  VP1__Norovirus__BAG70524
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLIFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1059 - protein, 540 aa, Artificial Sequence
  VP1__Norovirus__BAG70527
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNSYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1060 - protein, 540 aa, Artificial Sequence; identical to SEQ ID NO: 1055
  VP1__Norovirus__BAG70530

SEQ ID NO: 1061 - protein, 540 aa, Artificial Sequence; identical to SEQ ID NO: 1055
  VP1__Norovirus__BAG70533

SEQ ID NO: 1062 - protein, 540 aa, Artificial Sequence; identical to SEQ ID NO: 1055
  VP1__Norovirus__BAG70536

SEQ ID NO: 1063 - protein, 540 aa, Artificial Sequence; identical to SEQ ID NO: 621
  VP1__Norovirus__BAI70518

SEQ ID NO: 1064 - protein, 540 aa, Artificial Sequence
  VP1__Norovirus__BAJ13508
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDMALLRFVNPDTGRVLFECKLHKSGYVTVAHTGQHDLVIPPNGYFRFDSWVNQFYTLAPMGNGTGRRRAV

SEQ ID NO: 1065 - protein, 540 aa, Artificial Sequence
  VP1__Norovirus__BAJ13513
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDATHIAGSRSYTMNLASLNWNNYDPTEEIPAPLGTPDFVGKIQGMLTQTTKGDGSTRGHKATVYTGSAPFTPKLGSVQFSTDTENDFQTHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1066 - protein, 540 aa, Artificial Sequence
  VP1__Norovirus__BAJ13520
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGNVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1067 - protein, 540 aa, Artificial Sequence
  VP1__Norovirus__BAJ13534
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1068 - protein, 540 aa, Artificial Sequence
  VP1__Norovirus__BAJ13537
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNNHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1069 - protein, 540 aa, Artificial Sequence
  VP1__Norovirus__BAJ13540
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIVGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1070 - protein, 540 aa, Artificial Sequence; identical to SEQ ID NO: 1032
  VP1__Norovirus__BAJ13543

SEQ ID NO: 1071 - protein, 540 aa, Artificial Sequence; identical to SEQ ID NO: 1032
  VP1__Norovirus__BAJ13549

SEQ ID NO: 1072 - protein, 540 aa, Artificial Sequence
  VP1__Norovirus__BAJ13552
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1073 - protein, 540 aa, Artificial Sequence
  VP1__Norovirus__BAJ13555
MKMASNDPSPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1074 - protein, 540 aa, Artificial Sequence; identical to SEQ ID NO: 1072
  VP1__Norovirus__BAJ13558

SEQ ID NO: 1075 - protein, 540 aa, Artificial Sequence; identical to SEQ ID NO: 342
  VP1__Norovirus__BAJ13561

SEQ ID NO: 1076 - protein, 540 aa, Artificial Sequence
  VP1__Norovirus__BAJ13564
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1077 - protein, 540 aa, Artificial Sequence
  VP1__Norovirus__BAJ13567
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 1078 - protein, 540 aa, Artificial Sequence; identical to SEQ ID NO: 1072
  VP1__Norovirus__BAJ13573

SEQ ID NO: 1079 - protein, 540 aa, Artificial Sequence
  VP1__Norovirus__BAJ13576
MKMASNDANPSDGSAANLVPEVNNEVMALEPVVGAAIAAPVAGQQNVIDPWIRNNFVQAPGGEFTVSPRNAPGEIPWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1080 - protein, 540 aa, Artificial Sequence
  VP1__Norovirus__BAJ13579
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1081 - protein, 540 aa, Artificial Sequence; identical to SEQ ID NO: 472
  VP1__Norovirus__BAJ13582

SEQ ID NO: 1082 - protein, 540 aa, Artificial Sequence; identical to SEQ ID NO: 621
  VP1__Norovirus__BAJ13585

SEQ ID NO: 1083 - protein, 540 aa, Artificial Sequence
  VP1__Norovirus__BAJ13591
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLYKSGYVTVAHTGQHDLVIPPNGYFRFDSWVNQFYTLAPMGNGTGRRRAL

SEQ ID NO: 1084 - protein, 540 aa, Artificial Sequence
  VP1__Norovirus__BAJ13594
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1085 - protein, 540 aa, Artificial Sequence; identical to SEQ ID NO: 1072
  VP1__Norovirus__BAJ13597

SEQ ID NO: 1086 - protein, 540 aa, Artificial Sequence
  VP1__Norovirus__BAJ13603
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1087 - protein, 540 aa, Artificial Sequence
  VP1__Norovirus__BAJ13606
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTGDDFQTHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKAGYVTVAHTGQHDLVIPPNGYFRFDSWVNQFYTLAPMGNGTGRRRAL

SEQ ID NO: 1088 - protein, 540 aa, Artificial Sequence
  VP1__Norovirus__BAJ13609
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLTPMGNGTGRRRAL

SEQ ID NO: 1089 - protein, 540 aa, Artificial Sequence
  VP1__Norovirus__BAJ13612
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1090 - protein, 540 aa, Artificial Sequence
  VP1__Norovirus__BAJ13615
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1091 - protein, 540 aa, Artificial Sequence
  VP1__Norovirus__BAJ13618
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1092 - protein, 540 aa, Artificial Sequence; identical to SEQ ID NO: 342
  VP1__Norovirus__BAJ13621

SEQ ID NO: 1093 - protein, 540 aa, Artificial Sequence
  VP1__Norovirus__BAJ13624
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFAVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1094 - protein, 540 aa, Artificial Sequence
  VP1__Norovirus__BAJ13627
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1095 - protein, 540 aa, Artificial Sequence
  VP1__Norovirus__BAJ13630
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKAGYVTVAHTGQHDLVIPPNGYFRFDSWVNQFYTLAPMGNGTGRRRAL

SEQ ID NO: 1096 - protein, 540 aa, Artificial Sequence
  VP1__Norovirus__BAJ13633
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVS

SEQ ID NO: 1097 - protein, 540 aa, Artificial Sequence; identical to SEQ ID NO: 1072
  VP1__Norovirus__BAJ13636

SEQ ID NO: 1098 - protein, 540 aa, Artificial Sequence
  VP1__Norovirus__BAJ13639
MKMASNDANPSDGSAANLVQEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1099 - protein, 540 aa, Artificial Sequence; identical to SEQ ID NO: 1072
  VP1__Norovirus__BAJ13642

SEQ ID NO: 1100 - protein, 540 aa, Artificial Sequence
  VP1__Norovirus__BAJ13648
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1101 - protein, 540 aa, Artificial Sequence
  VP1__Norovirus__BAJ13651
MKMASNDANPSDGSAANLVPEVNNEVMALEPVVGAAIAAPVAGQQNVIDPWIRNNFVQAPGGEFTVSPRNAPSEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASINWNNYDPTEEIPAPLGTPDFVGKIQGVLTQTTKGDGSTRGHKATVYTGSAPFTPKLGSVQFSTDTENDFETHQNTKFTPVGVIQDGGTTHQNEPQQWVLPGYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1102 - protein, 540 aa, Artificial Sequence
  VP1__Norovirus__BAJ13654
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTIESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRGVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1103 - protein, 540 aa, Artificial Sequence
  VP1__Norovirus__BAJ13657
MKMASNDASPSDGSAANLVPEVNNEVMALEPVVGAAIAAPVAGQQNVIDPWIRNNFVQAPGGEFTVSPRNAPGEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1104 - protein, 540 aa, Artificial Sequence
  VP1__Norovirus__BAJ13660
MKMASNDANPSDGSAANLVPEVNNEVMALEPVVGAAIAAPVAGQQNVIDPWIRNNFVQAPGGEFTVSPRNAPGEIPWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1105 - protein, 540 aa, Artificial Sequence
  VP1__Norovirus__BAJ13663
MKMASNDANPSDGSAANLVPEVNNEGMALEPVVGAAIAAPVAGQTNVIDPWIRNNFVQAPGGEFTVSPRNAPSEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGNGSTRGHKATVYTGSAPFTPKLGSVQFSTDTENDFETHQNTKFTPVGVIQDGSTTHRNEPQQWVLPSYSGRSVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1106 - protein, 540 aa, Artificial Sequence
  VP1__Norovirus__BAJ13666
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDITHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1107 - protein, 540 aa, Artificial Sequence
  VP1__Norovirus__BAJ13669
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1108 - protein, 540 aa, Artificial Sequence
  VP1__Norovirus__BAJ13672
MKMASNDANRSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRSEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1109 - protein, 540 aa, Artificial Sequence
  VP1__Norovirus__BAJ13675
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1110 - protein, 540 aa, Artificial Sequence
  VP1__Norovirus__BAJ13678
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1111 - protein, 540 aa, Artificial Sequence
  VP1__Norovirus__BAJ13681
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1112 - protein, 540 aa, Artificial Sequence
  VP1__Norovirus__BAJ13684
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLVSLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRRAL

SEQ ID NO: 1113 - protein, 540 aa, Artificial Sequence
  VP1__Norovirus__BAJ13687
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1114 - protein, 540 aa, Artificial Sequence
  VP1__Norovirus__BAJ13690
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1115 - protein, 540 aa, Artificial Sequence
  VP1__Norovirus__BAJ13693
MKMASNDANPSDGSAANLVPEVNNEVMALEPVVGAAIAAPVAGQQNVIDPWIRNNFVKAPGGEFTVSPRNSPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1116 - protein, 540 aa, Artificial Sequence
  VP1__Norovirus__BAJ13696
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 1117 - protein, 540 aa, Artificial Sequence
  VP1__Norovirus__BAJ13699
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLIPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1118 - protein, 540 aa, Artificial Sequence
  VP1__Norovirus__BAJ13702
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1119 - protein, 540 aa, Artificial Sequence
  VP1__Norovirus__BAJ13711
MKMASNDANPSDGSAANLVPEVNNEVMALEPVVGAAIAAPVAAQQNVIDPWIRNNFVQAPGGEFTVSPRNAPSEILWSAPLGPDLNPYLSHFARMYNCYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1120 - protein, 540 aa, Artificial Sequence; identical to SEQ ID NO: 1084
  VP1__Norovirus__BAJ13714

SEQ ID NO: 1121 - protein, 540 aa, Artificial Sequence
  VP1__Norovirus__BAJ13717
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHVAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1122 - protein, 540 aa, Artificial Sequence
  VP1__Norovirus__BAJ13720
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNVCTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1123 - protein, 540 aa, Artificial Sequence
  VP1__Norovirus__BAJ13723
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTRGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1124 - protein, 540 aa, Artificial Sequence
  VP1__Norovirus__BAJ13726
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1125 - protein, 540 aa, Artificial Sequence; identical to SEQ ID NO: 1084
  VP1__Norovirus__BAJ13729

SEQ ID NO: 1126 - protein, 540 aa, Artificial Sequence; identical to SEQ ID NO: 1035
  VP1__Norovirus__BAJ13732

SEQ ID NO: 1127 - protein, 540 aa, Artificial Sequence; identical to SEQ ID NO: 342
  VP1__Norovirus__BAJ13738

SEQ ID NO: 1128 - protein, 540 aa, Artificial Sequence
  VP1__Norovirus__BAJ13741
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRRAL

SEQ ID NO: 1129 - protein, 540 aa, Artificial Sequence; identical to SEQ ID NO: 1072
  VP1__Norovirus__BAJ13744

SEQ ID NO: 1130 - protein, 540 aa, Artificial Sequence; identical to SEQ ID NO: 562
  VP1__Norovirus__BAJ13747

SEQ ID NO: 1131 - protein, 540 aa, Artificial Sequence; identical to SEQ ID NO: 621
  VP1__Norovirus__BAJ13750

SEQ ID NO: 1132 - protein, 540 aa, Artificial Sequence; identical to SEQ ID NO: 562
  VP1__Norovirus__BAJ13753

SEQ ID NO: 1133 - protein, 540 aa, Artificial Sequence
  VP1__Norovirus__BAJ13756
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRSYTMNLASLNWNNYDPTEEIPAPLGTPDFVGKIQGMLTQTTKGDGSTRGHKATVYTGSAPFTPKLGSVQFSTDTENDFQTHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1134 - protein, 540 aa, Artificial Sequence
  VP1__Norovirus__BAJ13759
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1135 - protein, 540 aa, Artificial Sequence; identical to SEQ ID NO: 621
  VP1__Norovirus__BAJ13762

SEQ ID NO: 1136 - protein, 540 aa, Artificial Sequence; identical to SEQ ID NO: 621
  VP1__Norovirus__BAJ13765

SEQ ID NO: 1137 - protein, 540 aa, Artificial Sequence; identical to SEQ ID NO: 1124
  VP1__Norovirus__BAJ13768

SEQ ID NO: 1138 - protein, 540 aa, Artificial Sequence
  VP1__Norovirus__BAJ13771
MKMASNDANPSDGSAANLVPEVNNEVMALEPVVGAAIAAPVAGQTNVIDPWIRNNFVQAPGGEFTVSPRNAPGEILWSAALGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1139 - protein, 540 aa, Artificial Sequence; identical to SEQ ID NO: 1072
  VP1__Norovirus__BAJ13774

SEQ ID NO: 1140 - protein, 540 aa, Artificial Sequence
  VP1__Norovirus__BAJ13777
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1141 - protein, 540 aa, Artificial Sequence; identical to SEQ ID NO: 1072
  VP1__Norovirus__BAJ13780

SEQ ID NO: 1142 - protein, 540 aa, Artificial Sequence; identical to SEQ ID NO: 1072
  VP1__Norovirus__BAJ13783

SEQ ID NO: 1143 - protein, 540 aa, Artificial Sequence; identical to SEQ ID NO: 621
  VP1__Norovirus__BAJ13786

SEQ ID NO: 1144 - protein, 540 aa, Artificial Sequence
  VP1__Norovirus__BAJ13792
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1145 - protein, 540 aa, Artificial Sequence
  VP1__Norovirus__BAJ13795
MKMASNDANPSDGSAANLVPEVNNEVMALEPVVGAAIAAPVAGQQNVIDPWIRNNFVQAPGGEFTVSPRNAPGEIPWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1146 - protein, 540 aa, Artificial Sequence
  VP1__Norovirus__BAJ13801
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1147 - protein, 540 aa, Artificial Sequence
  VP1__Norovirus__BAJ13804
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1148 - protein, 540 aa, Artificial Sequence; identical to SEQ ID NO: 621
  VP1__Norovirus__BAJ13807

SEQ ID NO: 1149 - protein, 540 aa, Artificial Sequence; identical to SEQ ID NO: 1147
  VP1__Norovirus__BAJ13810

SEQ ID NO: 1150 - protein, 540 aa, Artificial Sequence; identical to SEQ ID NO: 1147
  VP1__Norovirus__BAJ13816

SEQ ID NO: 1151 - protein, 540 aa, Artificial Sequence
  VP1__Norovirus__BAJ13819
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVIHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1152 - protein, 540 aa, Artificial Sequence; identical to SEQ ID NO: 1147
  VP1__Norovirus__BAJ13822

SEQ ID NO: 1153 - protein, 540 aa, Artificial Sequence
  VP1__Norovirus__BAJ13825
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLTPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDLALLRFVNPDTGRVLFECKLHKSGYVTVAHTGQHDLVIPPNGYFRFDSWVNQFYTLAPMGNGTGRRRAL

SEQ ID NO: 1154 - protein, 540 aa, Artificial Sequence
  VP1__Norovirus__BAJ13828
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEHSLYFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1155 - protein, 540 aa, Artificial Sequence; identical to SEQ ID NO: 621
  VP1__Norovirus__BAJ13831

SEQ ID NO: 1156 - protein, 540 aa, Artificial Sequence; identical to SEQ ID NO: 342
  VP1__Norovirus__BAJ13834

SEQ ID NO: 1157 - protein, 540 aa, Artificial Sequence; identical to SEQ ID NO: 621
  VP1__Norovirus__BAJ13837

SEQ ID NO: 1158 - protein, 540 aa, Artificial Sequence
  VP1__Norovirus__BAJ13840
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSAVFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1159 - protein, 540 aa, Artificial Sequence; identical to SEQ ID NO: 621
  VP1__Norovirus__BAJ13843

SEQ ID NO: 1160 - protein, 540 aa, Artificial Sequence; identical to SEQ ID NO: 621
  VP1__Norovirus__BAJ13846

SEQ ID NO: 1161 - protein, 540 aa, Artificial Sequence; identical to SEQ ID NO: 621
  VP1__Norovirus__BAJ13849

SEQ ID NO: 1162 - protein, 540 aa, Artificial Sequence
  VP1__Norovirus__BAJ13852
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPSNGYFRFDSWVNQFYTLAPMGNGTGRRRAL

SEQ ID NO: 1163 - protein, 540 aa, Artificial Sequence
  VP1__Norovirus__BAJ13855
MKMASNDANPSDGSAANLVPEVNNEVMALDPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFICLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1164 - protein, 540 aa, Artificial Sequence; identical to SEQ ID NO: 485
  VP1__Norovirus__BAJ13858

SEQ ID NO: 1165 - protein, 540 aa, Artificial Sequence
  VP1__Norovirus__BAJ13861
MKMRSSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTGSCRVLTRPSPDFDFIFLVPPTVESRTKPFSVSFFTGEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1166 - protein, 540 aa, Artificial Sequence; identical to SEQ ID NO: 485
  VP1__Norovirus__BAJ13864

SEQ ID NO: 1167 - protein, 540 aa, Artificial Sequence
  VP1__Norovirus__BAJ13867
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDCILDLPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1168 - protein, 540 aa, Artificial Sequence
  VP1__Norovirus__BAJ13873
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEVVFTVSCRVLTRPSPDFDFICLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPSNGYFRFDSWVNQFYTLAPMGNGTGRRRAL

SEQ ID NO: 1169 - protein, 540 aa, Artificial Sequence
  VP1__Norovirus__BAJ13876
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1170 - protein, 540 aa, Artificial Sequence
  VP1__Norovirus__BAJ13879
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMDLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1171 - protein, 540 aa, Artificial Sequence; identical to SEQ ID NO: 342
  VP1__Norovirus__BAJ13882

SEQ ID NO: 1172 - protein, 540 aa, Artificial Sequence
  VP1__Norovirus__BAJ13885
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1173 - protein, 540 aa, Artificial Sequence
  VP1__Norovirus__BAJ13891
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVASRTKPFSVPSVTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1174 - protein, 540 aa, Artificial Sequence
  VP1__Norovirus__BAJ13894
MKMASNDANPSDGSTANLVPEVNNEVMALEPVVGAAIAAPVAGQQNVIDPWIRNNFVQAPGGEFTVSPQNAPSEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1175 - protein, 540 aa, Artificial Sequence
  VP1__Norovirus__BAJ13897
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1176 - protein, 540 aa, Artificial Sequence
  VP1__Norovirus__BAJ13900
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1177 - protein, 540 aa, Artificial Sequence; identical to SEQ ID NO: 1169
  VP1__Norovirus__BAJ13903

SEQ ID NO: 1178 - protein, 540 aa, Artificial Sequence; identical to SEQ ID NO: 1176
  VP1__Norovirus__BAJ13906

SEQ ID NO: 1179 - protein, 540 aa, Artificial Sequence
  VP1__Norovirus__BAJ13909
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHITGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1180 - protein, 540 aa, Artificial Sequence; identical to SEQ ID NO: 342
  VP1__Norovirus__BAJ13912

SEQ ID NO: 1181 - protein, 540 aa, Artificial Sequence; identical to SEQ ID NO: 1107
  VP1__Norovirus__BAJ13918

SEQ ID NO: 1182 - protein, 540 aa, Artificial Sequence
  VP1__Norovirus__BAJ13924
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1183 - protein, 540 aa, Artificial Sequence
  VP1__Norovirus__BAJ13927
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSAQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1184 - protein, 540 aa, Artificial Sequence
  VP1__Norovirus__BAJ13930
MKMASNDANPSDGSAANLVPEVNNEVMALEPVVGAAIAAPVAGQQNVIDPWIRNNFVQAPGGEFTVSPRNAPGEILWSAPLDPDLNPYLSQLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1185 - protein, 540 aa, Artificial Sequence; identical to SEQ ID NO: 485
  VP1__Norovirus__BAJ13933

SEQ ID NO: 1186 - protein, 540 aa, Artificial Sequence; identical to SEQ ID NO: 342
  VP1__Norovirus__BAJ13936

SEQ ID NO: 1187 - protein, 540 aa, Artificial Sequence; identical to SEQ ID NO: 621
  VP1__Norovirus__BAJ13939

SEQ ID NO: 1188 - protein, 540 aa, Artificial Sequence
  VP1__Norovirus__BAJ13942
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1189 - protein, 540 aa, Artificial Sequence; identical to SEQ ID NO: 1147
  VP1__Norovirus__BAJ13945

SEQ ID NO: 1190 - protein, 540 aa, Artificial Sequence
  VP1__Norovirus__BAJ13948
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGNTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1191 - protein, 540 aa, Artificial Sequence; identical to SEQ ID NO: 485
  VP1__Norovirus__BAJ13951

SEQ ID NO: 1192 - protein, 540 aa, Artificial Sequence
  VP1__Norovirus__BAJ13954
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1193 - protein, 540 aa, Artificial Sequence
  VP1__Norovirus__BAJ13957
MKMASNDANPSDGSAANLVPEVNNEVMALEPVVGAAIAAPVAGQTNVIDPWIRNNFVQAPGGEFTVSPRNAPGEILWSAPSGPDLNPYLSHLARMFNDYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1194 - protein, 540 aa, Artificial Sequence; identical to SEQ ID NO: 621
  VP1__Norovirus__BAJ13960

SEQ ID NO: 1195 - protein, 540 aa, Artificial Sequence; identical to SEQ ID NO: 621
  VP1__Norovirus__BAJ13963

SEQ ID NO: 1196 - protein, 540 aa, Artificial Sequence; identical to SEQ ID NO: 1107
  VP1__Norovirus__BAJ13966

SEQ ID NO: 1197 - protein, 540 aa, Artificial Sequence; identical to SEQ ID NO: 342
  VP1__Norovirus__BAJ13969

SEQ ID NO: 1198 - protein, 540 aa, Artificial Sequence
  VP1__Norovirus__BAJ13972
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSVPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1199 - protein, 540 aa, Artificial Sequence
  VP1__Norovirus__BAJ13975
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1200 - protein, 540 aa, Artificial Sequence
  VP1__Norovirus__BAJ13978
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTIHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1201 - protein, 540 aa, Artificial Sequence; identical to SEQ ID NO: 621
  VP1__Norovirus__BAJ13981

SEQ ID NO: 1202 - protein, 540 aa, Artificial Sequence; identical to SEQ ID NO: 342
  VP1__Norovirus__BAJ13984

SEQ ID NO: 1203 - protein, 540 aa, Artificial Sequence; identical to SEQ ID NO: 342
  VP1__Norovirus__BAJ13987

SEQ ID NO: 1204 - protein, 540 aa, Artificial Sequence
  VP1__Norovirus__BAJ13990
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1205 - protein, 540 aa, Artificial Sequence; identical to SEQ ID NO: 342
  VP1__Norovirus__BAJ13993

SEQ ID NO: 1206 - protein, 540 aa, Artificial Sequence; identical to SEQ ID NO: 1147
  VP1__Norovirus__BAJ13996

SEQ ID NO: 1207 - protein, 540 aa, Artificial Sequence; identical to SEQ ID NO: 1084
  VP1__Norovirus__BAJ13999

SEQ ID NO: 1208 - protein, 540 aa, Artificial Sequence; identical to SEQ ID NO: 1147
  VP1__Norovirus__BAJ14002

SEQ ID NO: 1209 - protein, 540 aa, Artificial Sequence
  VP1__Norovirus__BAJ14005
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVLILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRRAL

SEQ ID NO: 1210 - protein, 540 aa, Artificial Sequence
  VP1__Norovirus__BAJ14008
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGTGRRRAL

SEQ ID NO: 1211 - protein, 540 aa, Artificial Sequence
  VP1__Norovirus__BAJ14011
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRRAL

SEQ ID NO: 1212 - protein, 540 aa, Artificial Sequence; identical to SEQ ID NO: 342
  VP1__Norovirus__BAJ14014

SEQ ID NO: 1213 - protein, 540 aa, Artificial Sequence
  VP1__Norovirus__BAK43269
MASNDAAPSTDGAAGLVPESNNEVMALEPVAGAALAAPVTGQTNIIDPWIRANFVQAPNGEFTVSPRNAPGEVLLNLELGPELNPYLAHLARLYNGYAGGMEVQVMLAGNAFTAGKLVFPAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDIEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1214 - protein, 540 aa, Artificial Sequence
  VP1__Norovirus__BAK43272
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTQNDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSRYVTVAHTGQHDLVIPPNGYFRFDSWVNQFYTLAPMGNGTGRRRAL

SEQ ID NO: 1215 - protein, 548 aa, Artificial Sequence
  VP1__Norovirus__BAK43275
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLANLNGTPYDPAEDIPGPLGTPDFRGKVFGVACQRNPDCTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1216 - protein, 540 aa, Artificial Sequence
  VP1__Norovirus__BAK43278
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSSYVTVAHTGQHDLVIPPNGYFRFDSWVNQFYTLAPMGNGTGRRHAL

SEQ ID NO: 1217 - protein, 540 aa, Artificial Sequence
  VP1__Norovirus__BAK43284
MASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFTVSIDQMYTSLNEVISVQCQNGRCTLDGELRGTTQLQVSGICAFKGEVTAHVHDNDHLYNVTITNLNGSPFDPSEDVPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1218 - protein, 547 aa, Artificial Sequence
  VP1__Norovirus__BAL14785
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHISTTDPRYTPKLGSILMRSESDDFVTGQPVRFTPIGMGDNDWHQWELPDYSGHLTLNMNLAPAVAPAFPGERILFFRSMVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1219 - protein, 582 aa, Artificial Sequence
  VP1__Norovirus__BAR88157
MKMASSDAASPSSDGAANLVPEINNEVMALEPVAGAQLAAPVADQFNAIDPWIRQNFVQAPEGEFTVSPRNAPGEILLNLELGPHLNPFLQHLAQMYNAYAGGMEVQVVLAGNAFTAGKIIFAAIPPHFPPERLSAAQATQFPHVIIDVRQLEPIVLPLPDVRHNLFHFNQQNDERMRLVAFLYTPLRANSGSGDDVFTVSCRVLTRPSPDFEFMFLVPPTVERKTVAFSLPQLTVGEMSNSRWPARITTMIADPHLPQVLRIQNGRCTLDGTLMGTTQLNPNDICRVRGYFSNSRPQVMCEGEDDALDQASLGAEPIRDQAPGLRTQARSTERWFAVTELNGQAYDPFGDQPAPLGVPDFEARIVGALVRLPGTNPTSNSRFEDAWIDTNNQTTYAPAAGMVAITTSDDSSSNYANDQVCEFLPLGVDITNSTPYNEFDLPSYGGSASSGNRNLAPTVAPTFPGEIVLLFGSNMPVQNRSAGTSNKEIRCLLPNEYIQHLYDTQAPSLSDVALVRYINPDTGRVLFEAKLHRDGFMTVNASATTVLPVDGHFRFDSWVNQFYALSPVGNASGRRGRNRRVD

SEQ ID NO: 1220 - protein, 540 aa, Artificial Sequence; identical to SEQ ID NO: 621
  VP1__Norovirus__BAS29993

SEQ ID NO: 1221 - protein, 540 aa, Artificial Sequence
  VP1__Norovirus__BAS29996
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1222 - protein, 540 aa, Artificial Sequence
  VP1__Norovirus__BAS29999
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGTGRRRAL

SEQ ID NO: 1223 - protein, 540 aa, Artificial Sequence
  VP1__Norovirus__BAS30005
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1224 - protein, 540 aa, Artificial Sequence
  VP1__Norovirus__BAS30008
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1225 - protein, 540 aa, Artificial Sequence; identical to SEQ ID NO: 1072
  VP1__Norovirus__BAS30011

SEQ ID NO: 1226 - protein, 540 aa, Artificial Sequence
  VP1__Norovirus__BAS30014
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPIFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1227 - protein, 540 aa, Artificial Sequence
  VP1__Norovirus__BAS30017
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSTFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1228 - protein, 540 aa, Artificial Sequence
  VP1__Norovirus__BAS30023
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1229 - protein, 540 aa, Artificial Sequence; identical to SEQ ID NO: 1107
  VP1__Norovirus__BAS30026

SEQ ID NO: 1230 - protein, 540 aa, Artificial Sequence
  VP1__Norovirus__BAS30029
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1231 - protein, 540 aa, Artificial Sequence
  VP1__Norovirus__BAS30035
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1232 - protein, 540 aa, Artificial Sequence; identical to SEQ ID NO: 1231
  VP1__Norovirus__BAS30038

SEQ ID NO: 1233 - protein, 540 aa, Artificial Sequence; identical to SEQ ID NO: 1228
  VP1__Norovirus__BAS30041

SEQ ID NO: 1234 - protein, 540 aa, Artificial Sequence
  VP1__Norovirus__BAS30044
MKMASNDANPSDGSAANLVPEVNNEVMALEPVVGAAIAAPVAGQQNVIDPWIRNNFVQAPGGEFTVSPRNAPGEILWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1235 - protein, 540 aa, Artificial Sequence; identical to SEQ ID NO: 1226
  VP1__Norovirus__BAS30047

SEQ ID NO: 1236 - protein, 540 aa, Artificial Sequence; identical to SEQ ID NO: 621
  VP1__Norovirus__BAS30050

SEQ ID NO: 1237 - protein, 540 aa, Artificial Sequence
  VP1__Norovirus__BAS30053
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFNTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1238 - protein, 540 aa, Artificial Sequence; identical to SEQ ID NO: 1228
  VP1__Norovirus__BAS30056

SEQ ID NO: 1239 - protein, 540 aa, Artificial Sequence
  VP1__Norovirus__BAS30059
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1240 - protein, 540 aa, Artificial Sequence; identical to SEQ ID NO: 1147
  VP1__Norovirus__BAS30062

SEQ ID NO: 1241 - protein, 540 aa, Artificial Sequence
  VP1__Norovirus__BAS30065
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTVVKTTLSAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1242 - protein, 540 aa, Artificial Sequence
  VP1__Norovirus__BAS30068
MKMASNDATASDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1243 - protein, 540 aa, Artificial Sequence; identical to SEQ ID NO: 1228
  VP1__Norovirus__BAS30071

SEQ ID NO: 1244 - protein, 540 aa, Artificial Sequence; identical to SEQ ID NO: 1228
  VP1__Norovirus__BAS30074

SEQ ID NO: 1245 - protein, 540 aa, Artificial Sequence
  VP1__Norovirus__BAS30077
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1246 - protein, 540 aa, Artificial Sequence
  VP1__Norovirus__BAS30080
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGQIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1247 - protein, 540 aa, Artificial Sequence; identical to SEQ ID NO: 621
  VP1__Norovirus__BAS30083

SEQ ID NO: 1248 - protein, 540 aa, Artificial Sequence
  VP1__Norovirus__BAS30086
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIANSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1249 - protein, 540 aa, Artificial Sequence
  VP1__Norovirus__BAS30089
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVSICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1250 - protein, 540 aa, Artificial Sequence
  VP1__Norovirus__BAS30092
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIASSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1251 - protein, 540 aa, Artificial Sequence
  VP1__Norovirus__BAS30095
MKMASNDANPFDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPAEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1252 - protein, 540 aa, Artificial Sequence
  VP1__Norovirus__BAS30098
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1253 - protein, 540 aa, Artificial Sequence
  VP1__Norovirus__BAS30101
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1254 - protein, 540 aa, Artificial Sequence
  VP1__Norovirus__BAS30104
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNAKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1255 - protein, 540 aa, Artificial Sequence
  VP1__Norovirus__BAS30107
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1256 - protein, 540 aa, Artificial Sequence; identical to SEQ ID NO: 1228
  VP1__Norovirus__BAS30110

SEQ ID NO: 1257 - protein, 540 aa, Artificial Sequence; identical to SEQ ID NO: 621
  VP1__Norovirus__BAS30113

SEQ ID NO: 1258 - protein, 540 aa, Artificial Sequence
  VP1__Norovirus__BAS30116
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFEIHQNTKFTPVGVIQDGSTTHRNEPQQWVLPSYSGRDAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1259 - protein, 540 aa, Artificial Sequence; identical to SEQ ID NO: 1228
  VP1__Norovirus__BAS30119

SEQ ID NO: 1260 - protein, 540 aa, Artificial Sequence
  VP1__Norovirus__BAS30125
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFEIHQNTKFTPVGVIQDGSTTHRNEPQQWVLPSYSGRDAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 1261 - protein, 540 aa, Artificial Sequence; identical to SEQ ID NO: 621
  VP1__Norovirus__BAS30128

SEQ ID NO: 1262 - protein, 540 aa, Artificial Sequence
  VP1__Norovirus__BAS30134
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1263 - protein, 540 aa, Artificial Sequence; identical to SEQ ID NO: 621
  VP1__Norovirus__BAS30137

SEQ ID NO: 1264 - protein, 540 aa, Artificial Sequence; identical to SEQ ID NO: 621
  VP1__Norovirus__BAS30140

SEQ ID NO: 1265 - protein, 540 aa, Artificial Sequence
  VP1__Norovirus__BAS30146
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1266 - protein, 540 aa, Artificial Sequence
  VP1__Norovirus__BAS30149
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1267 - protein, 540 aa, Artificial Sequence; identical to SEQ ID NO: 621
  VP1__Norovirus__BAS30152

SEQ ID NO: 1268 - protein, 540 aa, Artificial Sequence
  VP1__Norovirus__BAS30155
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFKGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHQNEPQQWVLPSYSGRDVPNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1269 - protein, 540 aa, Artificial Sequence
  VP1__Norovirus__BAS30158
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1270 - protein, 540 aa, Artificial Sequence
  VP1__Norovirus__BAS30164
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1271 - protein, 540 aa, Artificial Sequence; identical to SEQ ID NO: 1266
  VP1__Norovirus__BAS30167

SEQ ID NO: 1272 - protein, 540 aa, Artificial Sequence; identical to SEQ ID NO: 621
  VP1__Norovirus__BAS30170

SEQ ID NO: 1273 - protein, 540 aa, Artificial Sequence
  VP1__Norovirus__BAS30173
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRRAL

SEQ ID NO: 1274 - protein, 540 aa, Artificial Sequence
  VP1__Norovirus__BAS30176
MKMASNDANPSDGSAANLVPEVNNEVMALEPVVGAAIAAPVAGQQNVIDPWIRNNFVQAPGGEFTVSPRNAPGETLWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1275 - protein, 540 aa, Artificial Sequence
  VP1__Norovirus__BAS30179
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGLLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1276 - protein, 540 aa, Artificial Sequence
  VP1__Norovirus__BAS30182
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1277 - protein, 540 aa, Artificial Sequence
  VP1__Norovirus__BAS30185
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1278 - protein, 540 aa, Artificial Sequence
  VP1__Norovirus__BAS30188
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIHDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1279 - protein, 540 aa, Artificial Sequence; identical to SEQ ID NO: 1231
  VP1__Norovirus__BAS30191

SEQ ID NO: 1280 - protein, 540 aa, Artificial Sequence; identical to SEQ ID NO: 1231
  VP1__Norovirus__BAS30194

SEQ ID NO: 1281 - protein, 540 aa, Artificial Sequence; identical to SEQ ID NO: 1231
  VP1__Norovirus__BAS30197

SEQ ID NO: 1282 - protein, 540 aa, Artificial Sequence; identical to SEQ ID NO: 1231
  VP1__Norovirus__BAS30200

SEQ ID NO: 1283 - protein, 540 aa, Artificial Sequence; identical to SEQ ID NO: 1231
  VP1__Norovirus__BAS30203

SEQ ID NO: 1284 - protein, 540 aa, Artificial Sequence; identical to SEQ ID NO: 1231
  VP1__Norovirus__BAS30206

SEQ ID NO: 1285 - protein, 540 aa, Artificial Sequence
  VP1__Norovirus__BAS30209
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1286 - protein, 540 aa, Artificial Sequence
  VP1__Norovirus__BAS30212
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1287 - protein, 540 aa, Artificial Sequence
  VP1__Norovirus__BAS30215
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1288 - protein, 540 aa, Artificial Sequence; identical to SEQ ID NO: 1287
  VP1__Norovirus__BAS30218

SEQ ID NO: 1289 - protein, 540 aa, Artificial Sequence
  VP1__Norovirus__BAS30221
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKVQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1290 - protein, 540 aa, Artificial Sequence
  VP1__Norovirus__BAS30224
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1291 - protein, 540 aa, Artificial Sequence
  VP1__Norovirus__BAS30227
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRAKPFTVPILTVEEMTNSRFPIPLEKLFTGPSSAFVVQPQNGRCTTDGVLLGTTQLSPVNICTFRGDVTHIAGSRNYTMNLASPNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1292 - protein, 540 aa, Artificial Sequence
  VP1__Norovirus__BAS30230
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIASSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPAFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1293 - protein, 540 aa, Artificial Sequence; identical to SEQ ID NO: 621
  VP1__Norovirus__BAS30233

SEQ ID NO: 1294 - protein, 540 aa, Artificial Sequence; identical to SEQ ID NO: 1287
  VP1__Norovirus__BAS30236

SEQ ID NO: 1295 - protein, 540 aa, Artificial Sequence; identical to SEQ ID NO: 1287
  VP1__Norovirus__BAS30239

SEQ ID NO: 1296 - protein, 540 aa, Artificial Sequence
  VP1__Norovirus__BAS30242
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1297 - protein, 539 aa, Artificial Sequence
  VP1__Norovirus__BAS30245
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAIPPNFPTEGLSPSQVTMFPHIVVDVRQLEPVLIPLPDVRNNFYHYNQTKESTIKLVAMLYTPLRANNAGDDVFTVSCRVLTRPSPDFDFIFLVPPSVESRTKPFTVPILTVEEMTNSRFPIPLERLFTGPSSAFVVQPQNGRCTTDGVLLGTTQLSPVNICTFRGDVTRVSTTHVYEMNLASQNWNNYDPTEEVPAPLGTPDFVGKIQGVLTQTTRTDGSTRAHKATVSTGAADFTPKLGSIRFETTTNRDLETHQNTKFTPVGVIQDGDNHQNEPQQWRLPGYAGRDAHNVHLAPAVAPTFPGEQLLFFRSTMPGCSGYPNMNLDCLLPQEWVQHFYQEAAPAQSDVALLRFVNPDTGRVLFECKLHKSGYLTVAHTGPYDLVIPPNGYFRFDSWVNQFYTLAPMGNGTGRRRAL

SEQ ID NO: 1298 - protein, 540 aa, Artificial Sequence
  VP1__Norovirus__BAS30248
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKAIVYTGSADFAPKLGRVQFATDTDNDFGANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1299 - protein, 540 aa, Artificial Sequence; identical to SEQ ID NO: 562
  VP1__Norovirus__BAS30251

SEQ ID NO: 1300 - protein, 541 aa, Artificial Sequence
  VP1__Norovirus__BAS30254
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSKVSPIPLKKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1301 - protein, 540 aa, Artificial Sequence; identical to SEQ ID NO: 585
  VP1__Norovirus__BAS30257

SEQ ID NO: 1302 - protein, 540 aa, Artificial Sequence; identical to SEQ ID NO: 62
  VP1__Norovirus__BAS30260

SEQ ID NO: 1303 - protein, 540 aa, Artificial Sequence
  VP1__Norovirus__BAS30263
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESETKPFFFPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1304 - protein, 540 aa, Artificial Sequence; identical to SEQ ID NO: 585
  VP1__Norovirus__BAS30266

SEQ ID NO: 1305 - protein, 540 aa, Artificial Sequence; identical to SEQ ID NO: 585
  VP1__Norovirus__BAS30269

SEQ ID NO: 1306 - protein, 540 aa, Artificial Sequence; identical to SEQ ID NO: 585
  VP1__Norovirus__BAS30272

SEQ ID NO: 1307 - protein, 540 aa, Artificial Sequence
  VP1__Norovirus__BAS30275
MKMASNDANPSDGSTANLVPEVNNEVMALEPVVGAAIAAPVAGQQNVIDPWIRNNFVQAPGGEFTVSPRNAPGEILWSAPLGPDLNPYLFPLARKVKGYAGGFEVQVILAGKAFPAGKIIFAASPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRRDGSTRGHKATVYTGSADFSPKLGRVQFATDTDNDFDTHQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1308 - protein, 540 aa, Artificial Sequence; identical to SEQ ID NO: 585
  VP1__Norovirus__BAS30278

SEQ ID NO: 1309 - protein, 540 aa, Artificial Sequence; identical to SEQ ID NO: 58
  VP1__Norovirus__BAS30284

SEQ ID NO: 1310 - protein, 540 aa, Artificial Sequence
  VP1__Norovirus__BAS30287
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWINQFYTLAPMGNGTGRRRAL

SEQ ID NO: 1311 - protein, 540 aa, Artificial Sequence
  VP1__Norovirus__BAS30290
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRSIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1312 - protein, 540 aa, Artificial Sequence
  VP1__Norovirus__BAS30293
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRRAL

SEQ ID NO: 1313 - protein, 540 aa, Artificial Sequence
  VP1__Norovirus__BAS30296
MKMASNHVNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSIMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1314 - protein, 540 aa, Artificial Sequence; identical to SEQ ID NO: 563
  VP1__Norovirus__BAS30299

SEQ ID NO: 1315 - protein, 540 aa, Artificial Sequence
  VP1__Norovirus__BAS30302
MKMASSDANPFDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1316 - protein, 540 aa, Artificial Sequence
  VP1__Norovirus__BAS30305
MKMASSDANPSDGSTANLVPEVNNEVMALEPVVGAAIAAPVAGQQNVIDPWIRNNFVQAPGGEFTVSPRNAPGEILWSGTLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1317 - protein, 541 aa, Artificial Sequence
  VP1__Norovirus__BAS30308
MKMASNDVNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAVVRIIFSAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1318 - protein, 540 aa, Artificial Sequence; identical to SEQ ID NO: 22
  VP1__Norovirus__BAS30311

SEQ ID NO: 1319 - protein, 540 aa, Artificial Sequence
  VP1__Norovirus__BAS30314
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFENNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1320 - protein, 540 aa, Artificial Sequence
  VP1__Norovirus__BAS30317
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1321 - protein, 540 aa, Artificial Sequence; identical to SEQ ID NO: 1320
  VP1__Norovirus__BAS30320

SEQ ID NO: 1322 - protein, 540 aa, Artificial Sequence
  VP1__Norovirus__BAS30323
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGGTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1323 - protein, 540 aa, Artificial Sequence
  VP1__Norovirus__BAS30326
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1324 - protein, 540 aa, Artificial Sequence; identical to SEQ ID NO: 585
  VP1__Norovirus__BAS30329

SEQ ID NO: 1325 - protein, 540 aa, Artificial Sequence
  VP1__Norovirus__BAS30332
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPTPLEKLFTGPSSTFVVQPQNGRCTTDGVLLGTTQLSPVNICTFRGDVTHITGSHNYTMNLASQNWNSYDPTEEIPAPLGTPDFVGKIQGVLTQTTRTDGSTRGHKATVYTGSAEFSPKLGRVQVATDTNNDFDANQNTKFTPVGVIQDGGTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1326 - protein, 540 aa, Artificial Sequence
  VP1__Norovirus__BAS30335
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1327 - protein, 540 aa, Artificial Sequence; identical to SEQ ID NO: 562
  VP1__Norovirus__BAS30338

SEQ ID NO: 1328 - protein, 540 aa, Artificial Sequence; identical to SEQ ID NO: 62
  VP1__Norovirus__BAS30341

SEQ ID NO: 1329 - protein, 540 aa, Artificial Sequence
  VP1__Norovirus__BAS30344
MKMASSDANPSDGSTANLVPEVNNEVMALEPVVGAAIAAPVAGQQNVIDPWIRINFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1330 - protein, 540 aa, Artificial Sequence; identical to SEQ ID NO: 62
  VP1__Norovirus__BAS30347

SEQ ID NO: 1331 - protein, 540 aa, Artificial Sequence; identical to SEQ ID NO: 62
  VP1__Norovirus__BAS30350

SEQ ID NO: 1332 - protein, 540 aa, Artificial Sequence
  VP1__Norovirus__BAS30353
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1333 - protein, 540 aa, Artificial Sequence
  VP1__Norovirus__BAS30356
MKMASSDANPSDGSTANLVPEVNNEVMALEPVVGAAIAAPVAGQQNVIDPWIRNNFVQAPGGEFTVSPRNAPGEILWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1334 - protein, 540 aa, Artificial Sequence; identical to SEQ ID NO: 585
  VP1__Norovirus__BAS30359

SEQ ID NO: 1335 - protein, 540 aa, Artificial Sequence; identical to SEQ ID NO: 62
  VP1__Norovirus__BAS30362

SEQ ID NO: 1336 - protein, 540 aa, Artificial Sequence; identical to SEQ ID NO: 58
  VP1__Norovirus__BAS30365

SEQ ID NO: 1337 - protein, 540 aa, Artificial Sequence; identical to SEQ ID NO: 62
  VP1__Norovirus__BAS30368

SEQ ID NO: 1338 - protein, 540 aa, Artificial Sequence; identical to SEQ ID NO: 62
  VP1__Norovirus__BAS30371

SEQ ID NO: 1339 - protein, 540 aa, Artificial Sequence
  VP1__Norovirus__BAS30374
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTNGSTRGHKATVYTGSADFSPKLGRVQFATDTDNDFEANQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1340 - protein, 540 aa, Artificial Sequence
  VP1__Norovirus__BAU16297
MKMASNDDNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNKFYTLAPMGNGTGRRRAV

SEQ ID NO: 1341 - protein, 540 aa, Artificial Sequence
  VP1__Norovirus__BAU16299
MKMASNDAAPSNDGAAGLVPEGNNETLPLEPVAGAAIAAPVTGQNNIIDPWIRINFVQAPNGEFTVSPRNSPGEILLNLELGPDLNPYLAHLSRVYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAHDNVWQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMETGNGRRRAQ

SEQ ID NO: 1342 - protein, 544 aa, Artificial Sequence
  VP1__Norovirus__BAU16301
MMMASKDAAPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPVGFPDLGSCDWHIEMSKIPNSSTQSNPIVVNSVKPNSQQFVPHLSSITLDDNVSSGGDYIGTIQWTSPPSGSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 1343 - protein, 540 aa, Artificial Sequence
  VP1__Norovirus__BAU16303
MMMASKDVPTSPDGASGAGQLVPEVNTADQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPTLIQGMFVSPDVNQSVQFQNGRCQIDGQLQGTTPVSLSQLCKIRGKTSSNTRVLNLSEVDGTPFVPLESPAPVGFPDIGGCDWHVGFTFEARDQGPSQNVTFATNDSSFVPYLGSISPHNGDGFHSGDIIGSLDWISAPSDGSALDVWSIPKYGSSLPDVTHLAPAVFPPGFGEVILYFHSKFPGSGPTDKLRVPCLMPQEFITHFCDEQAPIAGEAALLHYVDPDAGRNLGEFKLYPDGFMTCVPNSISSGPQTLPINGVFVFVSWVSRFYQLKPVGTASMARRLGLRRI

SEQ ID NO: 1344 - protein, 548 aa, Artificial Sequence
  VP1__Norovirus__BAU16305
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFSTDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENVVVQCQNGRVTLDGELMGTTQLLPSQICAFRGVLTRSTSRASDQADTAAPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPIIVPPDGYFRFESWVNPFYTLAPMGIGNGRRRIQ

SEQ ID NO: 1345 - protein, 556 aa, Artificial Sequence
  VP1__Norovirus__BAU16306
MKMASSDAAPSADGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASPEADERAVGSFDVWIRLQEPDGQPYDIFGKQPAPIGTPDFKAVIVGFAARPLTSGSYANEAYVNTTASDYAPATGNMRFTVRNGGSGHISANKYWEFKSFGVEGERHTDIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRRGRVRFQ

SEQ ID NO: 1346 - protein, 541 aa, Artificial Sequence
  VP1__Norovirus__BAU16307
MMMASKDATPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHVIADVRTLEPLEIPLEDVRNTLYHNNDSQPTMRLLCMLYTPLRTGGGSGGTDAFVVAGRVLTCPSPDFNFLFLVPPTVEQKTRPFSVPNIPLQNLSNSRVPSLIQSMVLSSDHAQTVQFQNGRCTTDGHLLGTTPVSSGQLMKFRGKVTPGSKVLNLTELDGSPFLAFEPPAPAGFPDLGKCDWHIEMSLYQVNNQDNPIVLRAIEPNSSSFVPHLGSVSFNQNVDAAGDYVCTIQYTSPPSNSHDADVDFWSIPDYGSNLAEASQLAPVVYPPGFGEAIVYFMSRVPGWNRTNRLNLVPCLLPQEFIGHFVSEQAPAIGEAALLHYVDPDTNRNLGEFKLYPEGFITCVPNGTGPQQLPLNGVFVFSSWVSRFYQLKPVGTASSARGRLGIRR

SEQ ID NO: 1347 - protein, 540 aa, Artificial Sequence; identical to SEQ ID NO: 673
  VP1__Norovirus__BAU24831

SEQ ID NO: 1348 - protein, 540 aa, Artificial Sequence; identical to SEQ ID NO: 625
  VP1__Norovirus__BAU24834

SEQ ID NO: 1349 - protein, 540 aa, Artificial Sequence
  VP1__Norovirus__BAU24837
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFVPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1350 - protein, 540 aa, Artificial Sequence
  VP1__Norovirus__BAU24840
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTLRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1351 - protein, 540 aa, Artificial Sequence; identical to SEQ ID NO: 625
  VP1__Norovirus__BAU24843

SEQ ID NO: 1352 - protein, 540 aa, Artificial Sequence
  VP1__Norovirus__BAU24846
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSIMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1353 - protein, 540 aa, Artificial Sequence; identical to SEQ ID NO: 625
  VP1__Norovirus__BAU24849

SEQ ID NO: 1354 - protein, 540 aa, Artificial Sequence
  VP1__Norovirus__BAU24852
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1355 - protein, 540 aa, Artificial Sequence; identical to SEQ ID NO: 1352
  VP1__Norovirus__BAU24855

SEQ ID NO: 1356 - protein, 540 aa, Artificial Sequence; identical to SEQ ID NO: 673
  VP1__Norovirus__BAU24858

SEQ ID NO: 1357 - protein, 540 aa, Artificial Sequence
  VP1__Norovirus__BAU24861
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1358 - protein, 540 aa, Artificial Sequence; identical to SEQ ID NO: 625
  VP1__Norovirus__BAU24864

SEQ ID NO: 1359 - protein, 540 aa, Artificial Sequence
  VP1__Norovirus__BAU24867
MKMASSDANPTDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1360 - protein, 540 aa, Artificial Sequence; identical to SEQ ID NO: 673
  VP1__Norovirus__BAU24870

SEQ ID NO: 1361 - protein, 540 aa, Artificial Sequence; identical to SEQ ID NO: 625
  VP1__Norovirus__BAU24873

SEQ ID NO: 1362 - protein, 540 aa, Artificial Sequence; identical to SEQ ID NO: 625
  VP1__Norovirus__BAU24876

SEQ ID NO: 1363 - protein, 540 aa, Artificial Sequence; identical to SEQ ID NO: 625
  VP1__Norovirus__BAU24879

SEQ ID NO: 1364 - protein, 540 aa, Artificial Sequence
  VP1__Norovirus__BAU24882
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1365 - protein, 540 aa, Artificial Sequence
  VP1__Norovirus__BAU24885
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1366 - protein, 540 aa, Artificial Sequence; identical to SEQ ID NO: 625
  VP1__Norovirus__BAU24888

SEQ ID NO: 1367 - protein, 540 aa, Artificial Sequence
  VP1__Norovirus__BAU24891
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFATDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1368 - protein, 540 aa, Artificial Sequence; identical to SEQ ID NO: 673
  VP1__Norovirus__BAU24894

SEQ ID NO: 1369 - protein, 540 aa, Artificial Sequence
  VP1__Norovirus__BAU24897
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFVPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1370 - protein, 540 aa, Artificial Sequence; identical to SEQ ID NO: 625
  VP1__Norovirus__BAU24900

SEQ ID NO: 1371 - protein, 540 aa, Artificial Sequence; identical to SEQ ID NO: 625
  VP1__Norovirus__BAU24903

SEQ ID NO: 1372 - protein, 540 aa, Artificial Sequence; identical to SEQ ID NO: 913
  VP1__Norovirus__BAU24906

SEQ ID NO: 1373 - protein, 540 aa, Artificial Sequence; identical to SEQ ID NO: 625
  VP1__Norovirus__BAU24909

SEQ ID NO: 1374 - protein, 540 aa, Artificial Sequence; identical to SEQ ID NO: 673
  VP1__Norovirus__BAU24912

SEQ ID NO: 1375 - protein, 540 aa, Artificial Sequence
  VP1__Norovirus__BAU24915
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1376 - protein, 540 aa, Artificial Sequence; identical to SEQ ID NO: 625
  VP1__Norovirus__BAU24918

SEQ ID NO: 1377 - protein, 540 aa, Artificial Sequence; identical to SEQ ID NO: 625
  VP1__Norovirus__BAU24921

SEQ ID NO: 1378 - protein, 540 aa, Artificial Sequence; identical to SEQ ID NO: 625
  VP1__Norovirus__BAU24924

SEQ ID NO: 1379 - protein, 540 aa, Artificial Sequence
  VP1__Norovirus__BAU24927
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMELDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1380 - protein, 540 aa, Artificial Sequence
  VP1__Norovirus__BAU24930
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1381 - protein, 540 aa, Artificial Sequence; identical to SEQ ID NO: 585
  VP1__Norovirus__BAU24933

SEQ ID NO: 1382 - protein, 540 aa, Artificial Sequence
  VP1__Norovirus__BAU24936
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 1383 - protein, 540 aa, Artificial Sequence
  VP1__Norovirus__BAU24942
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEETPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1384 - protein, 540 aa, Artificial Sequence
  VP1__Norovirus__BAU24945
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1385 - protein, 540 aa, Artificial Sequence
  VP1__Norovirus__BAU24948
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTAHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1386 - protein, 540 aa, Artificial Sequence; identical to SEQ ID NO: 22
  VP1__Norovirus__BAU24950

SEQ ID NO: 1387 - protein, 540 aa, Artificial Sequence; identical to SEQ ID NO: 947
  VP1__Norovirus__BAU24952

SEQ ID NO: 1388 - protein, 540 aa, Artificial Sequence
  VP1__Norovirus__BAU24954
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRVV

SEQ ID NO: 1389 - protein, 540 aa, Artificial Sequence; identical to SEQ ID NO: 625
  VP1__Norovirus__BAU24958

SEQ ID NO: 1390 - protein, 540 aa, Artificial Sequence
  VP1__Norovirus__BAU24960
MKMASNDANPSDGPAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSIMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1391 - protein, 540 aa, Artificial Sequence; identical to SEQ ID NO: 673
  VP1__Norovirus__BAU24962

SEQ ID NO: 1392 - protein, 540 aa, Artificial Sequence; identical to SEQ ID NO: 1352
  VP1__Norovirus__BAU24964

SEQ ID NO: 1393 - protein, 540 aa, Artificial Sequence; identical to SEQ ID NO: 1352
  VP1__Norovirus__BAU24966

SEQ ID NO: 1394 - protein, 540 aa, Artificial Sequence
  VP1__Norovirus__BAU24968
MKMASSDANPSDGSTANLVPEVNNEVMALEPVIGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHMIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1395 - protein, 540 aa, Artificial Sequence
  VP1__Norovirus__BAU24972
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1396 - protein, 540 aa, Artificial Sequence
  VP1__Norovirus__BAU24974
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRTTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1397 - protein, 540 aa, Artificial Sequence; identical to SEQ ID NO: 681
  VP1__Norovirus__BAU24976

SEQ ID NO: 1398 - protein, 540 aa, Artificial Sequence; identical to SEQ ID NO: 673
  VP1__Norovirus__BAU24978

SEQ ID NO: 1399 - protein, 540 aa, Artificial Sequence; identical to SEQ ID NO: 673
  VP1__Norovirus__BAU24980

SEQ ID NO: 1400 - protein, 540 aa, Artificial Sequence
  VP1__Norovirus__BAU24982
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRIQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1401 - protein, 540 aa, Artificial Sequence; identical to SEQ ID NO: 673
  VP1__Norovirus__BAU24984

SEQ ID NO: 1402 - protein, 540 aa, Artificial Sequence; identical to SEQ ID NO: 625
  VP1__Norovirus__BAU24986

SEQ ID NO: 1403 - protein, 540 aa, Artificial Sequence
  VP1__Norovirus__BAU24988
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTVPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1404 - protein, 540 aa, Artificial Sequence
  VP1__Norovirus__BAU24990
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1405 - protein, 540 aa, Artificial Sequence
  VP1__Norovirus__BAU24992
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRYTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1406 - protein, 540 aa, Artificial Sequence; identical to SEQ ID NO: 679
  VP1__Norovirus__BAU24994

SEQ ID NO: 1407 - protein, 540 aa, Artificial Sequence
  VP1__Norovirus__BAU24996
MKMASSDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1408 - protein, 540 aa, Artificial Sequence; identical to SEQ ID NO: 673
  VP1__Norovirus__BAU24998

SEQ ID NO: 1409 - protein, 540 aa, Artificial Sequence
  VP1__Norovirus__BAU25002
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1410 - protein, 540 aa, Artificial Sequence; identical to SEQ ID NO: 625
  VP1__Norovirus__BAU25004

SEQ ID NO: 1411 - protein, 547 aa, Artificial Sequence
  VP1_protein__Norovirus__ADN84676
MKMASSDAAPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPNLTLDELSNSRFPAPIVQLYTNPHDNLVVQPQNGRCTIDGLLQGTTQLVSCNVCSFRGTMGEGQPASHSEDEIMPMAINVQREIMLENLDGSPYDPTDDIPAVLGSPDFQGVMFGILSQRNTDGQTRAHEAKVDTRAARFAPKLGFVVATVESTDFHANQPSRFTPVGLGGDANRDFNQWQLPAYGGALTNNTNLAPPVMPVYPGEQLLFFRSQLPSSGGVVAGWLDCLLPQEWVQHFFQESATSQSNVALVRYVNPTTGRVLFEAKLHKQGFLTVAASGSYPLVVPADGYFRFESWVNEFYTLAPMGNGSGRRRAR

SEQ ID NO: 1412 - protein, 540 aa, Artificial Sequence
  VP1_protein__Norovirus__BAK68870
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1413 - protein, 539 aa, Artificial Sequence
  capsid__Norovirus__AAC54893
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQSHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTHIVGSHDYTMNLASQNWSNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYITVAHTGPFDLVIPPNGYFRFDSWVNQFYTLAPMGNGTGRRRAL

SEQ ID NO: 1414 - protein, 548 aa, Artificial Sequence
  capsid__Norovirus__AAW30195
MKMASNDATPSNDGAAGLVPEINNEAMALDPVAGAAIAAPLTGQQNIIDPWIMNNFVQAPGGELTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDTRLRLIAMLYTPLRANSSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGMLTRSTSRASDQADTAAPRLFNYHWHIQLDNLNGTPYDPAEDIPGPLGTPDFRGKVFGVASQRNPDSTTRAHEAKVDTTAGRFTPKLGSLEISTESGDLDQNQPTKFTPVGIGVDHEEDFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFGFESWVNPFYTLAPMGTGNGRRRIQ

SEQ ID NO: 1415 - protein, 548 aa, Artificial Sequence
  capsid__Norovirus__ABD36491
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRASDQADTATPRLFNYYWHIQLDNLNGTPYDPAEDIPAPLGTPDFRGKVFGVASQRNPDSTTRAHEAKVDTTSGRFAPKLGSLEISTESSDFDSNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1416 - protein, 542 aa, Artificial Sequence
  capsid__Norovirus__ABD36494
MKMASNDAAPSNDGAASLVPEGINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAICSYRGRTVANNGDNWDQNLLQLTYPNGASYDPTDEVPAPLGTQDFSGMLYGVLTQDNTNVSAGEAKNAKGIYISTTSGKFTPKIGSIGLHSITEHVYPNQQSRFTPVGVAVNENTPFQQWVLPHYAGSLALNTNLAPAVAPTFPGEQLLFFRSRVPCVQGQQGQDVFIDCLLPQEWVNHFYQEAAPSQADVALIRYVNPDTGRTLFEAKLHRSGFITVSHTGAYPLVVPPNGHFRFDSWVNQFYSLAPMGTGNGRRRIQ

SEQ ID NO: 1417 - protein, 537 aa, Artificial Sequence
  capsid__Norovirus__ABD36497
MKMASNDAAPSSDGAAGLVPEINHEVMAIEPVAGASIAAPVVGQQNIIDPWIRNNFVQAPAGEFTVSPRNAPGEFLLDLELGPDLNPYLAHLARMYNGHAGGMEVQIVLAGNAFTAGKILFAVIPPGFPYENLSPAQLTMCPHVVVDVRQLEPVMLPMPDIRNTFFHYNQDGGPRLRLIAMLYTPLRANNSGDDVFTVSCRVLTRPAPDFEFTFLVPPSVESKTKAFTIPVLKISEMTNSRFPVPVDQMYTSRSEGIVVQPQNGRATIDGELLGTTLVSPVSVCNFKGNLQTEVPGQHQQYQLQLTNLDGSPIDPTDDTPGPLGCPDFIGLLYGVASQRGPGDATRAHEARIDTGSDTYAPKIGQVRFYSTSNNFETNQPTHFTPVGVYIEGSSSDFNQWQLPRYGGHLANNNHLAPAVSPLFPGEQILFFRSFIPGASGHTNGEMDCLLPQEFVQHFYQEAATAQSEVALLRFVNPDTGRVLFESKLHKQGFMTIASSGDHPIIMPTNGYFRFEAWVNQFYSLAPVGTGSGRRRIQ

SEQ ID NO: 1418 - protein, 540 aa, Artificial Sequence
  capsid__Norovirus__ABL74387
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFEAGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAYTGQHDLVIPPNGYFRFDSWVNQFYTLAPMGNGAGRRRAL

SEQ ID NO: 1419 - protein, 540 aa, Artificial Sequence
  capsid__Norovirus__ABL74389
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIRLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEVPAPLGTPDFVGKIQGVLTQTTRGDGSTRGHKATVSTGSVHFTPKLGSVQFSTDTSNDFETGQNTRFTPVGVVQDGSTTHQNEPQQWVLPDYSGRDNHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1420 - protein, 540 aa, Artificial Sequence; identical to SEQ ID NO: 472
  capsid__Norovirus__ABL74397

SEQ ID NO: 1421 - protein, 530 aa, Artificial Sequence
  capsid__Norovirus__ABQ44562
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGVSSGNYIGVLSWVSPPSHPSGSQVDLWKIPNYGSSITEATHLAPSVYPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTASTARGRLGLRR

SEQ ID NO: 1422 - protein, 545 aa, Artificial Sequence
  capsid__Norovirus__ABQ44563
MMMASKGAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFVAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLEWVSPVSDGHKGDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRLGIRRS

SEQ ID NO: 1423 - protein, 544 aa, Artificial Sequence
  capsid__Norovirus__ABQ44564
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEVSKIPNSSTQSNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 1424 - protein, 540 aa, Artificial Sequence
  capsid__Norovirus__ABQ44565
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGSPFIPLESPAPVGFPDLGGCDWHVNFTFQAQDQDPSQSVTFATNDASFVPYLGSISPHNGGDFHSGDIIGSLGWISAPSDSSQLNVWTIPKYGSSLPDVTHLAPAVFPPGFGEVILYFYSTFPGSGQPGQLQVPCLLPQEFITHFCNEQAPIAGEAALLHYVDPDTGRNLGEFKLYPDGFMTCVPNSVSSGPQTLPINGVFVFVSWVSRFYQLKPVGTASVARRLGLRRI

SEQ ID NO: 1425 - protein, 544 aa, Artificial Sequence
  capsid__Norovirus__ABQ44566
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEVPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDTDYSPNTSIICTLDWLSQTTGQSNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRLGIRRS

SEQ ID NO: 1426 - protein, 535 aa, Artificial Sequence
  capsid__Norovirus__ABQ44567
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNNFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRSTLDGELLGTTQLVPSNICSLRGRINAHLPDNQHRWNMQVTNANGTPFDPTEDVPAPLGTPDFLANIYGVTSQRNPDNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSSGAIDCLLPQEWVQHFYQESAPSSTDVALIRYTNPDTGRVLFEAKLHRQGFITVANSGSRPIVVPPNGYFRFDSWVNQFYSLAPMGTGNGRRRVQ

SEQ ID NO: 1427 - protein, 542 aa, Artificial Sequence
  capsid__Norovirus__ABQ44568
MNMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKQNAAGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1428 - protein, 548 aa, Artificial Sequence
  capsid__Norovirus__ABQ44569
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1429 - protein, 540 aa, Artificial Sequence
  capsid__Norovirus__ABQ44570
MKMASNDAAPSNDGAAGLVPESNNEAMALEPVMGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEVTNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYIPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 1430 - protein, 550 aa, Artificial Sequence
  capsid__Norovirus__ABQ44571
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGPQEQGHYATRAHEAHIDTTDPKYAPKLGTILIKSESNDFITNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 1431 - protein, 540 aa, Artificial Sequence
  capsid__Norovirus__ABQ44572
MKMASNDAAPSSDGAAGLVPEINNEVMPLDPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVDVMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEANINTGGDQYAPKLAQVKFFSESQDFEVHQPTTFTPVGVAGDNSHPFRQWTLPRYGGHLTNNTHLAPAVAPLFPGEQLLFFRSQIPSSGGHESGYMDCLVPQEWVQHFYQEAATAQSEVALIRFINPDTGRVLFEAKLHKQGFITVAHTGDNPIVMPPNGYFRFEAWVNQFYSLAPVGTGNGRRRVQ

SEQ ID NO: 1432 - protein, 535 aa, Artificial Sequence
  capsid__Norovirus__ABQ44573
MKMASNDAAPSNDGAAGLVPEANNETMALEPVAGASIAAPLTGQNNIIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPVPLGTPDFSGKLFGVLSQRDHDNACRSHDAVIATNSAKFTPKLGAIQIGTWEENDVHINQPTKFTPVGLFEDEGFNQWTLPNYSGALTLNVGLAPPVAPTFPGEQILFFRSHIPLKGGVADPVIDCLLPQEWIQHLYQESAPSQSDVALIRFTNPDTGRVLFEAKLHRSGYITVANTGSRPIVVPANGYFRFDSWVNQFYSLAPMGTGNGRRRVQ

SEQ ID NO: 1433 - protein, 537 aa, Artificial Sequence
  capsid__Norovirus__ABQ44574
MKMASNDATPSDDGAAGLVPEINNEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRVPRCFGTKCIQARNENIIVQPQNGRCTTDGELLGTTTLQSVSICNFRGTMQAKLNEQPRYQLQLTNLDGSPIDPTDDMPAPLGTPDFQAMLYGVASQRSSRDNATRAHDAQIDTAGDTFAPKIGQVRFKSSSGDFDLHDPTKFTPIGVNVDDQHPFRQWSLPNYGGHLALNNHLAPAVTPLFPGEQILFFRSHIPSAGGHTDGAMDCLLPQEWIEHFYQEAAPSQSDIALVRFINPDTGRVLLEAKLHKQGFLTVAASGDHPIVMPTNGYFRFEAWVNPFYTLAPVGTGSGRRRIQ

SEQ ID NO: 1434 - protein, 546 aa, Artificial Sequence
  capsid__Norovirus__ABQ44575
MKMASNDAAPSNDGAASLVPEGINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNETNVVQCQNGRCTLDGELQGTTQLLSSAVCSYRGRTVANNGDNWDQNLLQLTYPNGASYDPTDEVPAPLGTQDFSGMLYGVLTQDNVNVSTGEAKNAKGIYISTTSGKFTPKIGSIGLHSITEHVHPNQQSRFTPVGVAVNENTPFQQWVLPHYAGSLALNTNLAPAVAPTFPGEQLLFFRSRVPCVQGLQGQDAFIDCLLPQEWVNHFYQEAAPAPAPSQADVALIRYVNPDTGRTLFEAKLHRSGFITVSHTGAYPLVVPPNGHFRFDSWVNQFYSLAPMGTGNGRRRIQ

SEQ ID NO: 1435 - protein, 540 aa, Artificial Sequence
  capsid__Norovirus__ABQ44576
MKMASNDAAPSNDGAAGLVPEVNNETLALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNSFFHYNQQSDQRMRLIAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNIQVTNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVVVPPNGYFRFDSWVNQFYSLAPMGTGNGRRRMQ

SEQ ID NO: 1436 - protein, 522 aa, Artificial Sequence
  capsid__Norovirus__ACJ04900
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNSLSHSRAMEPIAQMMSSRNFPASVQFQNGRCTLSGDLLGTTPSSPADVGTFVGLIAEPGSHVVELSQPNQEDFHAGSAPAPFGFPDFSDCSLTFVVASASTVGERTVNTRSPQNFTPALGHITFDEEAPADLFRAHLRNLWDPTEHSFWRIPDYRADVLGGEFAPSVSAPGVGETLLFFMCNVPRSNGANPNPCPCLLPQEWITHFVSERAALQSDVALLNYINPNTGRVLFECKLYANGFLTVNLGASDQATLPVDGIFKFVSWVSFYYQLRPVGNIGVGRRLPRLDGF

SEQ ID NO: 1437 - protein, 522 aa, Artificial Sequence
  capsid__Norovirus__ACJ04903
MKMTDRDTIDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEERETPFTLPNLPVNSLSHSRVMEPIAQMMSSRNFPASVQFQNGRCTLSGDLLGTTPSSPADLGTFVGLIAEPGSHVAELSQPNQEDFHAGSAPAPFGFPDFSECSLTFVVASASTVGERTVNTRSLQNFTPALGHITFDEEAPADLFRAHLRNLWDPTEHSFWRIPDYRADVLGGEFAPSVSAPGVGETLLFFMCNVPRLNGANPNPCPCLLPQEWITHFVSERAALQSDVALLNYINPNTGRVLFECKLYVNGFLTVNLGASDQATLPVDGIFKFVSWVSFYYQLRPVGNIGVGRRLPRLDGF

SEQ ID NO: 1438 - protein, 522 aa, Artificial Sequence
  capsid__Norovirus__ACJ04906
MKMTDRDVTDSAPALGQVLPPEVEASVPVEPTAGAPVAAPTAGQVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVEMPLEDVRNILFHQGPDSRMRLMGMLYTPLRANSGADPFVVTGRVLTCPSPNFSFFFLVPPTVEEREPPFTLPNLPVNNLSHSRVMEPIAQMMSSRNFPASVQFQNGRCTLSGDLLGTTPSSPSDLGAFVGLIAEPGSRVVELSQPNQEDFHAGSAPAPFGFPDFSDCSLTFVVASATTVGERTVNARSPQNFTPALGHITFDEEAPADLFRAHLRNLWDPTEHSFWRIPDYRADVLGSEFAPSVSAPGVGETLLFFMCNVPRLNGANPNPCPCLLPQEWITHFVSERAALQSDVALLNYVNPNTGRVLFEAKLYANGFLTVNLGASDQATLPVDGIFKFVSWVSFYYQLRPVGNASVGRRLPRLDGF

SEQ ID NO: 1439 - protein, 540 aa, Artificial Sequence
  capsid__Norovirus__ACY00565
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQSGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNVDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1440 - protein, 540 aa, Artificial Sequence; identical to SEQ ID NO: 1266
  capsid__Norovirus__ACY00568

SEQ ID NO: 1441 - protein, 540 aa, Artificial Sequence
  capsid__Norovirus__ACY00571
MKMASNDANPSDGSAANLVPEVNNEVMALEPVVGAAIAAPVAGQQNVIDPWIRNNFVQAPGGEFTVSPRNAPGEILWSAPLGPDLNPNLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1442 - protein, 540 aa, Artificial Sequence
  capsid__Norovirus__ACY00573
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1443 - protein, 540 aa, Artificial Sequence
  capsid__Norovirus__ACY00576
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYSRFDPWVNQFYTLAPMGNGTGRRRAL

SEQ ID NO: 1444 - protein, 540 aa, Artificial Sequence
  capsid__Norovirus__ACY00579
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNASTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1445 - protein, 540 aa, Artificial Sequence
  capsid__Norovirus__ACY00582
MKMASNDANPSDGSVANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDSTIKLIAMLYTPLRADNAGEDVFTVSCRVLTRPSPDFDFIFLVPPTVESKTKPFTVPILTVEEMTNSRFPIPLEKLFTGPSSTFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYSRFDSWVNQFYTLAPMGNGTGRRRAL

SEQ ID NO: 1446 - protein, 540 aa, Artificial Sequence
  capsid__Norovirus__ACY00588
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQAILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSLQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1447 - protein, 540 aa, Artificial Sequence
  capsid__Norovirus__ACY00594
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQPNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTHGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1448 - protein, 540 aa, Artificial Sequence
  capsid__Norovirus__ACY00597
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVGVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFKGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1449 - protein, 540 aa, Artificial Sequence
  capsid__Norovirus__ACY00600
MKMASNDANPSDGPAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSSNYTMNLASLNWNNYDPTEEIPAPLGTPDFVGKIQGVLTQTTKGDGSTRGHKATVYTGSAPFTPKLGSVQFSTDTQNDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSRYVTVAHTGQHDLVIPPNGYFRFDSWVNQFYTLAPMGNGTGRRRAL

SEQ ID NO: 1450 - protein, 540 aa, Artificial Sequence
  capsid__Norovirus__ACY00603
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNALTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVPTQTTKGDGSTRGHKATVYTGSAPFTPKLGSVQFSTDTENDFEAHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1451 - protein, 540 aa, Artificial Sequence
  capsid__Norovirus__ACY00606
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQMILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHGLVIPPNGYFRFDSWVNQFYTLAPMGNGTGRRRAL

SEQ ID NO: 1452 - protein, 540 aa, Artificial Sequence
  capsid__Norovirus__ACY00609
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTDPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCPLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1453 - protein, 540 aa, Artificial Sequence
  capsid__Norovirus__ACY00612
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFMGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1454 - protein, 543 aa, Artificial Sequence
  capsid__Norovirus__ACY00615
MMMASKDAPTNMDGTSGAGQLVPEANTAEPLPIKPVAGAATAVATAGQVNMIDPWIMNNFVQAPQGEFTISPNNTPGDILFDLQLGPHLNPFLAHLSRMYNGWVGNMQVRIMLAGNAFSAGKIIVCCIPPGFSSQSISIAQATMFPHVIADVRVLEPIDVPLDDVRNVLFHNNDNPQTMRLLCMLYTPLRSGGTSSGTDPFVIAGRVLTCPTPDFSFLFLVPPDIEQRTKPFSVPNIPMNLMSNSRVSMLIDGMMVSNDQNQVPQFQNGRVTLDGQLQDTTTVSAACVARMRGRIFNNNGNYGVNLTELDGNPYHAFDSPAPLGFPDFGNCDLHMTFVKINPNELSSGDPSGKVVIHSYDATFAPHLGTVKLENDDELARFVGKEVVLELTWVSNREGATLNLWAVPNYGSSLTQASQLAPPIYPPGFGEAIVYFTSTFPTVSNPKVPCTLPQEFVSHFVNEQAPTRGDAALLHYVDPDTHRNLGEFKMYPEGYMTCVPNAGGGPQTLPINGVFVFISWVSRYYQLKPVGTAGAARRLGLRRS

SEQ ID NO: 1455 - protein, 540 aa, Artificial Sequence
  capsid__Norovirus__ACY00618
MMMASKDAPTSPDGASGAGQLVPEANTAEQISMDPVAGASTAVATAGQVNMVDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 1456 - protein, 540 aa, Artificial Sequence
  capsid__Norovirus__ACY00621
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 1457 - protein, 536 aa, Artificial Sequence
  capsid__Norovirus__ACY00623
MKMASNDATPSDDGAAGLVPGINSEVMALEPVAGASIAAPVVGQQNIIDPWIRNNFVQAPAGEFTVSPRNSPGELLLDLELGPELNPYLAHLARMYNGHAGGMEVQIVLAGNAFTAGEILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAMLYGVASQRSSTDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 1458 - protein, 548 aa, Artificial Sequence
  capsid__Norovirus__ACY00629
MKMASIDAAPSNDGAAGLVPEINNEAMALDPVAGAAIAAPLTGQQNIIDPWIMNNFVQAPGGEFTVSPRNSPGEVLLNLELGPEINPYLAHLARMYNGFAGGFEVQVVLAGNAFTAGKIIFAAIPPNFPIDNLSAAQITMCPHVIVDVRQLEPVNLPMPDVRNNFFHYNQGSDSKLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLVPMGTGNGRRRIQ

SEQ ID NO: 1459 - protein, 537 aa, Artificial Sequence
  capsid__Norovirus__ACY00632
MASNDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADIVVQPQNGRCTLDGELQGTTQLLTTAICSYRGMTSNPTSDYWDDHLLHLVHPNGATYDPTEDVPAPFGTQDFRGILYGMLTQNPRTSGDEAANSHGIYISSTSEKFTPKLGTIGLHQVQGRHSQHQQSKFTPVGIAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRVQ

SEQ ID NO: 1460 - protein, 538 aa, Artificial Sequence
  capsid__Norovirus__ACY00635
MKMASNDAAPSNDGAAGLVPEINNEVMALEPVAGGAIAAPLTGQTNVIDPWIRTNFVQAPNGEFTISPRNSPGEVLLNMELGPELNPFLGHLSRMYNGYAGGIEVQVLMAGNAFTAGKVIFAAVPPHFPVENLSPPQVTMFPHVIVDVRTLEPILLPLPDVRNQFFHYSQVDEPKMRLVAMLYTPLRSNGSAEDVFTVSCRVLTRPSPDFEFNYLVPPTVESRTKPFTVPILTIGEMSNSRFPAPIDVIYTSPNDNQNVQPQNGRCTLDGELQGTTQLVPSGVCAFRGRITSHEGSEQNQWHMQLTNLNGTPFDPTEDIPAPLGTPDFKGEIFGFISQRNAQNDPGQSQPANRAHDAVVSTRAPKFTPKLGSVMIGTWVNSDIENQPSKFTPVGLNSSENFKQWELPDYSGVLTLNMGLAPVVHPTYPGEQILFFRSYIPLKGGHGNPAIDCLLPQEWIQHFYQESAPSQTDVALLNPDTGRVLFEAKLHRQGYITIAKSGDGPIVVPPNGYFRFDSWVNQFYSLAPMGNGNGRRRVQ

SEQ ID NO: 1461 - protein, 543 aa, Artificial Sequence
  capsid__Norovirus__ACY00638
MMMASKDAPTNMDGTSGAGQLVPEVSTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPDLPLNVLSNSRVPSLIKSMMVSQDHGQMVQFQNGRVTLDGQLQGTTPTSASQLCKIRGTVYHATGGQGLNLTEIDGTPYHAFESPAPIGFPDLGECDWHINASPANAFTDGSIIHRIDVVQDPTFAPHLGTIHYTNANYDANVSLICSLEWLSPPSGGALKANPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRLGIRRS

SEQ ID NO: 1462 - protein, 544 aa, Artificial Sequence
  capsid__Norovirus__ACY00641
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGSGINLTELNGEPYHAFESPAPIGFPDLGGCDWHLTATPTQAFNDGAKVVRLSVTQGAAFAPHLGTIHYTTTDTDYNPNTSIICTLDWLSQTTGQSNVDPWQIPTYGSTLTEAAQLAPPIFPPGFGETLVFFLSDFPISNGKNGLSVPCTLPQEFVTHFVNEQAPIRGEAALLHYADPDTHRNLGEFKLYPEGFMTCVPNTSGGGPQTLPINGVFVFVSWVSRFYQLKPVGTAGAARRLGIRRS

SEQ ID NO: 1463 - protein, 544 aa, Artificial Sequence
  capsid__Norovirus__ACY00645
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGSGINLTELNGEPYHAFESPAPIGFPDLGGCDWHLTATPTQAFNDGAKVVRLSVTQGAAFAPHLGTIHYTTTDTDYNPNTSIICTLDWLSQTTGQSNVDPWQIPTYGSALTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRLGIRRS

SEQ ID NO: 1464 - protein, 544 aa, Artificial Sequence
  capsid__Norovirus__ACY00647
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNSPTMRLVCMLYTPLRASGSSSGTDPFVIAGRVLTCPSPDFSFLFLVPPNVEQKTKPFSVPNLPLNTLSNSRVPSLINAMMISRDHGQMVQFQNGRVTLDGQLQGTTPTSLSQLCKIRGKVFHASGGNGLNLTELDGSAYHAFESPAPIGFPDIGECDWHMNATATSNFTGSNDEYQILVKQESTFAPHLGHVQADSLSADANTDLMVSLSWISPVSDQHRRDVDPWVIPRYGSSLTEAAQLAPPIYPPGFGEAIVFFMSDFPVVSGVNGMRIPCTLPQEYVAHFVNEQAPTRGEAALLHYVDPDTHRNLGEFKMYPEGFMTCVPNSSGSGPQTLPINGVLTFVSWVSRFYQLKPVGTAGPARRLGIRRS

SEQ ID NO: 1465 - protein, 555 aa, Artificial Sequence
  capsid__Norovirus__ACY00650
MRMASSDAPVSGTDGAAGLVPESQQEVLPLEPVAGVQLAAPVAGQSNIIDPWIRMNFVQAPAGEFTVSPRDAPGEVLIDLELGPELNPYLNHLARMYNGYVGGMEVEVVLAGNAFTAGKILFAAVPPSFPTHGISAAQATMLPHVIVDVRQLEPVRLPLPDVRNVMFHFCQENKEPRMRIVAILYTPLRANGAGDDVFTVSCRVLTRPSPDFDFIFLVLPSVESKLKQFTLPNLQPNEMTNSRFPTGIIQLYTSPNTNLVVQFQNGRCLLDGTLLGTTPVRAADICSFRGVTSTEVDATDSPRVAGSHRIMVQLKEPDGEEFSPTGPNPAPVGTPDFQAAIFGTLSQRNTGGAGQNSNRARFAYFYTRNPTFAPGIGTVVFSFDTTDFQNRQPTKFSPSGVFDDDSSEPFNQFSLPYYNGSLGAVDAGKLAPPVAPNYPGEQILYFRGNIPFKGGYGEGEIDSLLPQEWITHFYAEQAPTQGDAALLRYYNPDTGRVLFECKLHREGFITINYTGSNALAVPVNGVFRFEGWVNKFYTLTPMGNGNGRRGRRREL

SEQ ID NO: 1466 - protein, 538 aa, Artificial Sequence
  capsid__Norovirus__ACY00656
MASNDAAPSNDGAAGLVPEVNNETMALEPVAGASIAAPLTGQNNVIDPWIRLNFVQAPNGEFTVSPRNSPGEILLNLELGPELNPYLAHLSRMYNGYAGGVEVQVLLAGNAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLADDRHLWNIQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKGGFITVSSTENRPVIVPPNGYFRFDSWVNQFYSLAPMGTGNGRRRMQ

SEQ ID NO: 1467 - protein, 540 aa, Artificial Sequence
  capsid__Norovirus__ADK47170
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTAEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1468 - protein, 547 aa, Artificial Sequence
  capsid__Norovirus__ADR30514
MKMASNDAAPSNDGAADLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMSLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1469 - protein, 540 aa, Artificial Sequence
  capsid__Norovirus__ADR78255
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1470 - protein, 540 aa, Artificial Sequence
  capsid__Norovirus__ADR78259
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1471 - protein, 540 aa, Artificial Sequence
  capsid__Norovirus__ADR78262
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1472 - protein, 540 aa, Artificial Sequence
  capsid__Norovirus__ADR78266
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1473 - protein, 540 aa, Artificial Sequence; identical to SEQ ID NO: 1470
  capsid__Norovirus__ADR78268

SEQ ID NO: 1474 - protein, 522 aa, Artificial Sequence
  capsid__Norovirus__AFQ00093
MKMTDRDIVDSAPALGQVLPPEVEASVPVEPTAGAPVAASTAGRVNPIDPWIFANFVQAPQGEFTISPNNNPGEILFELELGPDLNPYLAHLRRMYNGWTGSMRVRVLLAGNAFSAGKVVVFCVPPGFDTSYLTPSQATQFPHVLIDVRAPEPVDMPLEDVRNILFHQGPDSRMRLMGMLYTPLRANSGADPFVVTGRVLTCPSPNFSFFFLVPPTVEEREPPFTLPNLPVNSLSHSRVMEPIAQMMSSRSFPASVQFQNGRCTLSGDLLGTTPSSPADLGAFVGLIAEPGSRVVELSQPNQEDFHAGSAPAPFGFPDFSECSVTFVVASATTVGERTVNARNPQNFTPALGHITFDEEAPADLFRARFRNLWEPTEHSFWRIPDYRADVLGSDFAPSVSAPGVGETLLFFMCNVPRLNGANPNPCPCLLPQEWITHFVSERAALQSDVALLNYVNPNTGRVLFEAKLYANGFLTVNLGASDQAILPVDGIFKFVSWVSFYYQLRPVGNISVGRRLPRLDGF

SEQ ID NO: 1475 - protein, 542 aa, Artificial Sequence
  capsid__Norovirus__BAI52939
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPASIDQMYTSPNEVISVQCQNGRCTLDGELQGTTQLQVSGICAFKGEVTAHLHDNDHLYNITITNLNGSPFDPSEDIPAPLGMPDFQGRVFGIISQRDRHNSPGHNEPANRGHDAVVPTYTAQYTPKLGQIQIGTWQTDDLTVSQPVKFTPVGLNDTEHFNQWVVPRYAGALNLNTNLAPSVAPVFPGERLLFFRSYIPLKGGYGNPAIDCLLPQEWVQHFYQEAAPSMSEVALVRCINPDTGRALFEAKLHRAGFMTVSSNTSAPVVVPANGYFRFDSWVNQFYSLAPMGTGNGRRRVQ

SEQ ID NO: 1476 - protein, 540 aa, Artificial Sequence
  capsid__Norovirus__BAI52940
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTRIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1477 - protein, 540 aa, Artificial Sequence
  capsid__Norovirus__BAQ20801
MKMASSDANPSDGSAANLVPEVNNEDMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSANFSPKLGRVQFETDTDHDFEVNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1478 - protein, 540 aa, Artificial Sequence
  capsid__Norovirus__BAQ20803
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSANFSPKLGRVQFETDTDHDFEVNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1479 - protein, 540 aa, Artificial Sequence
  capsid__Norovirus__BAQ20805
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTGESRTKPFSVPVLTVEEMTNSRFPIPLEKLFTGPSSAFVVQPQNGRCTTDGVLLGTTQLSPVNICTFRGDVTHTTGSHNYTMNLASQNWNNYDPTEEIPAPLGTPDFVGKIQGMLTQTTRTDGSTRGHKATVYTGSADFAPKLGRVQFGTDTDHDLEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1480 - protein, 548 aa, Artificial Sequence
  capsid_protein__Norovirus__AAB06271
MKMASNRAAPSNDGAACLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAAKIIFAAIPPNFPIDNLSAAQITMCPHVIVDVRQLEPINLPMPDVRNNFFHYNQGSDSRLRLIAMLYTPLRANNSGDDVFTVSCRVLTRPSPDFLFNFLVPPTVESKTKPFTLPILTISEMSNSRFPVPIDSLHTSPTENIVVQCQNGRVTLDGELMGTTQLLPSQICAFRGTLTGSTSRASDQADTPTPRLFNHHWHIQLDNLNGTPYDPAEDIPAPLGTPDFRGKVFGVAGQRNPDSTTRAHEAKVDTTSGRFTPKLGSLEITTESDDLDLSQPTKFTPVGIGVDNRAEFQQWSLPDYSGQFTHNMNLAPAVAPNFPGEQLLFFRSQLPSSGGRSNGVLDCLVPQEWVQHFYQESAPAQTQVALVRYVNPDTGRVLFEAKLHKLGFMTVAKNGDSPITVPPNGYFRFESWVNPFYTLAPMGTGNGRRRIQ

SEQ ID NO: 1481 - protein, 539 aa, Artificial Sequence
  capsid_protein__Norovirus__AAK96218
MKMASSDANPSDGSTANLVPEVNNEVMALEPVVGAAIAGPVAGQQNVIDPWIRNNFVQAPGGEFTVSPTNAPGEILWSAPLGPDLNPYLSHLARMYNGYAGGFEVQVILAGNAFTAGKIIFAAVPPNFPTEGLSPSQVTMFPHIIVDVRQLEPVLIPLPDARNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSVFVVQPQNGRCTTDGVLLGTTQLSAVNICTFRGDVTHIAGSHDYTMNLASQNWNNYDPTEEIPAPLGTPDFVGKIQGMLTQTTREDGSTRATKATVSTGSVHFTPKLGSVQYTADTNNDFQTGQNTKFTPVGVIQDGSNHQNEPQQWVLTNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDPWVNQFYTLAPMGNGAGRRRAL

SEQ ID NO: 1482 - protein, 540 aa, Artificial Sequence
  capsid_protein__Norovirus__AAR97648
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1483 - protein, 540 aa, Artificial Sequence
  capsid_protein__Norovirus__AAR97651
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1484 - protein, 540 aa, Artificial Sequence; identical to SEQ ID NO: 1482
  capsid_protein__Norovirus__AAR97654

SEQ ID NO: 1485 - protein, 540 aa, Artificial Sequence; identical to SEQ ID NO: 1482
  capsid_protein__Norovirus__AAR97657

SEQ ID NO: 1486 - protein, 540 aa, Artificial Sequence; identical to SEQ ID NO: 1482
  capsid_protein__Norovirus__AAR97660

SEQ ID NO: 1487 - protein, 540 aa, Artificial Sequence
  capsid_protein__Norovirus__AAR97663
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1488 - protein, 540 aa, Artificial Sequence
  capsid_protein__Norovirus__AAS86774
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPVDAMYTSPNDSIVVQPQNGRATIDGELLGTTQLIPSGICSFRGKITTHLSDDRHLWNIQVSNLNGTPFDPTDDVPAPLGMPDFSGQIFGVVSQRDTGTNPANRAHDAVLATYSAKYTPKLGSVQIGTWDTDDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1489 - protein, 540 aa, Artificial Sequence
  capsid_protein__Norovirus__AAS86777
MKMASNDAAPSNDGAAGLVPEVNNETMALEPVAGASIAAPLTGQNNVIDPWIRLNFVQAPNGEFTVSPRNSPGEVLLNLELGPELNPYLAHLARMYNGYAGGVEVQVLLAGNAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNIQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGYGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1490 - protein, 540 aa, Artificial Sequence
  capsid_protein__Norovirus__AAS86780
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPIQGMFMSPDVNQSVQFQNGRCQIDGQLQGTTPVSLSQLCKIRGKTSSNARVLNLSEVDGTPFVPLESPAPVGFPDLGGCDWHVNFTFQAQNQDPSQSVTFATNDASFVPYLGSISPHNGGDFHAGDIIGSLGWISAPSDNTQLNVWTIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 1491 - protein, 540 aa, Artificial Sequence
  capsid_protein__Norovirus__AAS86783
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLFHNSSQPQPTMRLVAMLYTPLRTGGGSGGTDAFVVAGRVLTCPAPDFSFLFLVPPSVEQKTRVFSVPNVPLKDLSNSRVPVPIQGMFMSPDVNQSVQFQNGRCQIDGQLQGTTPVSLSQLCKIRGKTSSNARVLNLSEVDGSPFIPLESPAPVGFPDLGGCDWHVNFTFQAQDQDPSQSVTFATNDASFVPYLGSISPHNGGDFHSGDIIGSLGWISAPSDSSQLNVWTIPKYGSSLPDVTHLAPAVFPPGFGEVILYFYSTFPGSGQPVQLQVPCLLPQEFITHFCNEQAPIAGEAALLHYVDPDTGRNLGEFKLYPDGFMTCVPNSVSSGPQTLPINGVFVFVSWVSRFYQLKPVGTASVARRLGLRRI

SEQ ID NO: 1492 - protein, 540 aa, Artificial Sequence
  capsid_protein__Norovirus__AAS86786
MKMASNDAAPSNDGATGLVPEINNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPANRMRLVAMLYTPLRSNGSGDDVFTVSCRVLTRPTPDFEFTYLVPPSVESKTKPFSLPILTISELTNSRFPAPIDSLFTAQNNNLNVQCQNGRCTLDGELQGTTQLLPSGICAFRGRLTADVDGSHDDRWHMQLTNLNGTPFDPTEDVPAPLGTPDFTGLLFGVASQRNVGSNPNTTRAHEAVVSTTSSQFVPKLGSVNFGSTSTDFQLQQPTKFTPVGIKIESGHEFDQWALPRYSGHLTLNMNLAPPIAPNFPGEQLLFFRSNVPCAGGVSDGVIDCLLPQEWIQHFYQESAPSQSDVALIRYVNPDTGRTLFEAKLHRTGYITVAHSGDYPLVVPSNGYFRFDSWVNQFYSLAPMGTGNGRRRVQ

SEQ ID NO: 1493 - protein, 540 aa, Artificial Sequence
  capsid_protein__Norovirus__AAS86792
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNNFFHYNQQSDQRMRLIAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNVQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1494 - protein, 540 aa, Artificial Sequence
  capsid_protein__Norovirus__AAS86795
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNIQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1495 - protein, 540 aa, Artificial Sequence
  capsid_protein__Norovirus__AAS86798
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNNFFHYSQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNIQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1496 - protein, 540 aa, Artificial Sequence; identical to SEQ ID NO: 1494
  capsid_protein__Norovirus__AAS86801

SEQ ID NO: 1497 - protein, 540 aa, Artificial Sequence
  capsid_protein__Norovirus__AAS86804
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAIPPHFPVDNLSPGQITMFPHVIIDVRTLEPVLLPLPDVRNNFFHYNQQSDQRMRLIAMLYTPLRSNGSGDDVFTVSCRVLTRPSPDFDFNYLVPPTVESKTKPFSVPVLTLNELTNSRFPVPIDAMYTSPNDSVVVQPQNGRATIDGELLGTTQLIPSGICSFRGKITTHLSDDRHLWNIQVSNLNGTPFDPTDDVPAPLGMPDFSGQIFGVISQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGNPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 1498 - protein, 530 aa, Artificial Sequence
  capsid_protein__Norovirus__AAS86807
MMMASKDATSNVDGASGAGQLVPEANTSDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQSTLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISSMGISPDNVQSVQFQNGRCTLDGRLVGTTPVSLSQVAKIRGTSNGTVINLTELDGTPFHPFEGPAPIGFPDLGGCDWHVNMTQFGHSSQTQFDVDTTPETFVPHLGSIQANGVGSGNYIGVLSWISPPSHPSGSQVDLWKIPNYGSSITEATHLAPSVFPPGFGEVLVFFMSKIPGPGAYNLPCLLPQEYISHFASEQAPTVGEAALLHYVDPDTGRNLGEFKAYPDGFLTCVPNGASSGPQQLPINGVFVFVSWVSRFYQLKPVGTASSARGRLGLRR

SEQ ID NO: 1499 - protein, 540 aa, Artificial Sequence
  capsid_protein__Norovirus__AAT00237
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1500 - protein, 540 aa, Artificial Sequence; identical to SEQ ID NO: 1499
  capsid_protein__Norovirus__AAT00240

SEQ ID NO: 1501 - protein, 540 aa, Artificial Sequence; identical to SEQ ID NO: 1499
  capsid_protein__Norovirus__AAT00243

SEQ ID NO: 1502 - protein, 540 aa, Artificial Sequence; identical to SEQ ID NO: 1499
  capsid_protein__Norovirus__AAT00246

SEQ ID NO: 1503 - protein, 540 aa, Artificial Sequence
  capsid_protein__Norovirus__AAT00249
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKTGYVTVAHTGQHDLVIPPNGYFRFDSWVNQFYTLAPMGNGTGRRRAL

SEQ ID NO: 1504 - protein, 540 aa, Artificial Sequence
  capsid_protein__Norovirus__AAT00255
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1505 - protein, 540 aa, Artificial Sequence; identical to SEQ ID NO: 1504
  capsid_protein__Norovirus__AAT00258

SEQ ID NO: 1506 - protein, 540 aa, Artificial Sequence; identical to SEQ ID NO: 1504
  capsid_protein__Norovirus__AAT00261

SEQ ID NO: 1507 - protein, 540 aa, Artificial Sequence; identical to SEQ ID NO: 1504
  capsid_protein__Norovirus__AAT00264

SEQ ID NO: 1508 - protein, 540 aa, Artificial Sequence; identical to SEQ ID NO: 1504
  capsid_protein__Norovirus__AAT00267

SEQ ID NO: 1509 - protein, 540 aa, Artificial Sequence; identical to SEQ ID NO: 1504
  capsid_protein__Norovirus__AAT00270

SEQ ID NO: 1510 - protein, 540 aa, Artificial Sequence; identical to SEQ ID NO: 1504
  capsid_protein__Norovirus__AAT00273

SEQ ID NO: 1511 - protein, 540 aa, Artificial Sequence; identical to SEQ ID NO: 1504
  capsid_protein__Norovirus__AAT00276

SEQ ID NO: 1512 - protein, 540 aa, Artificial Sequence; identical to SEQ ID NO: 1504
  capsid_protein__Norovirus__AAT00279

SEQ ID NO: 1513 - protein, 540 aa, Artificial Sequence; identical to SEQ ID NO: 1504
  capsid_protein__Norovirus__AAT00282

SEQ ID NO: 1514 - protein, 540 aa, Artificial Sequence; identical to SEQ ID NO: 1504
  capsid_protein__Norovirus__AAT00285

SEQ ID NO: 1515 - protein, 540 aa, Artificial Sequence; identical to SEQ ID NO: 1504
  capsid_protein__Norovirus__AAT00288

SEQ ID NO: 1516 - protein, 540 aa, Artificial Sequence; identical to SEQ ID NO: 1504
  capsid_protein__Norovirus__AAT00291

SEQ ID NO: 1517 - protein, 540 aa, Artificial Sequence; identical to SEQ ID NO: 1504
  capsid_protein__Norovirus__AAT00294

SEQ ID NO: 1518 - protein, 540 aa, Artificial Sequence; identical to SEQ ID NO: 1504
  capsid_protein__Norovirus__AAT00297

SEQ ID NO: 1519 - protein, 540 aa, Artificial Sequence; identical to SEQ ID NO: 1504
  capsid_protein__Norovirus__AAT00300

SEQ ID NO: 1520 - protein, 540 aa, Artificial Sequence; identical to SEQ ID NO: 1504
  capsid_protein__Norovirus__AAT00303

SEQ ID NO: 1521 - protein, 540 aa, Artificial Sequence; identical to SEQ ID NO: 1504
  capsid_protein__Norovirus__AAT00306

SEQ ID NO: 1522 - protein, 540 aa, Artificial Sequence; identical to SEQ ID NO: 1504
  capsid_protein__Norovirus__AAT00309

SEQ ID NO: 1523 - protein, 540 aa, Artificial Sequence; identical to SEQ ID NO: 1504
  capsid_protein__Norovirus__AAT00312

SEQ ID NO: 1524 - protein, 540 aa, Artificial Sequence; identical to SEQ ID NO: 1504
  capsid_protein__Norovirus__AAT00315

SEQ ID NO: 1525 - protein, 540 aa, Artificial Sequence; identical to SEQ ID NO: 1504
  capsid_protein__Norovirus__AAT00318

SEQ ID NO: 1526 - protein, 540 aa, Artificial Sequence; identical to SEQ ID NO: 1504
  capsid_protein__Norovirus__AAT00321

SEQ ID NO: 1527 - protein, 540 aa, Artificial Sequence; identical to SEQ ID NO: 1499
  capsid_protein__Norovirus__AAT00324

SEQ ID NO: 1528 - protein, 540 aa, Artificial Sequence
  capsid_protein__Norovirus__AAT00330
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSAMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1529 - protein, 540 aa, Artificial Sequence; identical to SEQ ID NO: 1528
  capsid_protein__Norovirus__AAT00333

SEQ ID NO: 1530 - protein, 540 aa, Artificial Sequence; identical to SEQ ID NO: 1528
  capsid_protein__Norovirus__AAT00336

SEQ ID NO: 1531 - protein, 540 aa, Artificial Sequence
  capsid_protein__Norovirus__AAT00342
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1532 - protein, 540 aa, Artificial Sequence; identical to SEQ ID NO: 1504
  capsid_protein__Norovirus__AAT00345

SEQ ID NO: 1533 - protein, 540 aa, Artificial Sequence
  capsid_protein__Norovirus__AAT00348
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTRFTPVGVVQDGNGTHQNEPQQWVLPSYSGRTGHNVHLAPAVAPTFPGEQLLFFRSTTPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1534 - protein, 540 aa, Artificial Sequence; identical to SEQ ID NO: 1504
  capsid_protein__Norovirus__AAT00351

SEQ ID NO: 1535 - protein, 540 aa, Artificial Sequence; identical to SEQ ID NO: 1504
  capsid_protein__Norovirus__AAT00354

SEQ ID NO: 1536 - protein, 540 aa, Artificial Sequence; identical to SEQ ID NO: 1504
  capsid_protein__Norovirus__AAT00357

SEQ ID NO: 1537 - protein, 540 aa, Artificial Sequence; identical to SEQ ID NO: 1504
  capsid_protein__Norovirus__AAT00360

SEQ ID NO: 1538 - protein, 540 aa, Artificial Sequence; identical to SEQ ID NO: 1499
  capsid_protein__Norovirus__AAT00363

SEQ ID NO: 1539 - protein, 540 aa, Artificial Sequence; identical to SEQ ID NO: 1504
  capsid_protein__Norovirus__AAT00366

SEQ ID NO: 1540 - protein, 540 aa, Artificial Sequence; identical to SEQ ID NO: 1504
  capsid_protein__Norovirus__AAT00369

SEQ ID NO: 1541 - protein, 540 aa, Artificial Sequence; identical to SEQ ID NO: 1504
  capsid_protein__Norovirus__AAT00372

SEQ ID NO: 1542 - protein, 540 aa, Artificial Sequence; identical to SEQ ID NO: 1504
  capsid_protein__Norovirus__AAT00375

SEQ ID NO: 1543 - protein, 548 aa, Artificial Sequence
  capsid_protein__Norovirus__AAT70110
MKMASKDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDNEADFQQWSLPDYSGQFTHNMNLAPAVAPNFPGEQLLFFRSQLPSSGGRSNGILDCLVPQEWVQHFYQESAPSQTQVALVRYVNPDTGRVLFEAKLHKLGFMTIAKNGDSPITVPPNGYFRFESWVNPFYTLAPMGTGNGRRRIQ

SEQ ID NO: 1544 - protein, 540 aa, Artificial Sequence
  capsid_protein__Norovirus__AAT73592
MASKDAAPSTDGAAGLVPESNNEVMALEPVAGAALAAPVTGQTNIIDPWIRTNFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGETSNSRFPVPIDQMYTSPNEVISVQCQNGRCTLDGELQGTTQLQVSGICAFKGQVTAHLQDNEHLYNVTITNLNGSPFDPSEDIPAPLGVPDFEGRVFGVISQRDNYNSGGQNQPANRSHDAVVPTYTAQYTPKLGQIQIGTWQTDDITVDQPAKFTPVGLSDTDHFNQWVVPRYAGALNLNTNLAPSVAPVFPGERLLFFRSYIPLKGGFGNPAIDCLVPQEWIQHFYQEATPSLSEVALVRYINPDTGRALFEAKLHRAGFMTVSSNTSAPVVVPANGYFRFDSWVNQFYSLAPMGTGNGRRRIQ

SEQ ID NO: 1545 - protein, 537 aa, Artificial Sequence
  capsid_protein__Norovirus__AAT78480
MASKDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCSLDGELQGTTQLLTTAICSYRGMTSNPTRDYWDGHLLHLVHPNGATYDPTEDVPAPFGTQDFRGILYGVLTQNPRASGDEAANSQGVYISSTSEKFTPKLGTIGLHQVQGHHSQHQQSKFTPLGVAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRIQ

SEQ ID NO: 1546 - protein, 544 aa, Artificial Sequence
  capsid_protein__Norovirus__AAT78481
MASKDAPSNMDGTSGAGQLVPEANTADPIPLEPVVGAATAAATAGQVNMIDPWIMNNFVQSPEGEFTISPNNTPGDILFDLQLGPHLNPFLQHLSQMYNGWVGNMRVRILLAGNAFSAGKIIICCVPPGFTAQNISIAQATMFPHVIADVRVLEPIEIPLDDVRNVLFHTNENRPTMRLLCMLYTPLRAGGASAGTDPFVIAGRVLTCPSPDFNFLFLVPPSVEQKTRQLTVPNIPLNNLSNSSVPAMINKMAISSDANQVVQFQNGRCTTDGQLLGTTPISASQVARIRGKVFSTSSGKGLNLSELDGSPYHAFESPAPVGFPDLGHCDWHVSSFKADQNSSGDPISRLDIKQGASFAPHLGSIEYTTSQNPDGGQLGTLTWISSPSDDTPGHGTINLWKIPSYGSTVTESVHLAPPIYPPGFGETLVNLMSNFPIGHTNSNMAQVPCTLPQEFVAHFVNEQAPVRGDAALLHYVDPDTHRNLGEFKLYPEGYITCVPNTGGGGPQSLPTNGVFIFSSWVSRYYQLEPVGTAGPARRLGVRRV

SEQ ID NO: 1547 - protein, 539 aa, Artificial Sequence
  capsid_protein__Norovirus__AAU95776
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLKANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1548 - protein, 547 aa, Artificial Sequence
  capsid_protein__Norovirus__AAX32874
MKMASNDAAPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTIGDGQPASHSEEEIMPMAFNIQREIMLENLDGSPYDPADDIPAVLGSPDFQGIVFGVLSQRNADGQTRAHEAKVDTRAARFAPKLGFVVATVESTDFHANQPSRFTPVGLGGDGNQDFNQWALPAYGGALTNNTNLAPPVMPVYPGEQILYFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRTR

SEQ ID NO: 1549 - protein, 557 aa, Artificial Sequence
  capsid_protein__Norovirus__AAX32877
MMMASNDATAPTDGAAGLVPEVTNETMALEPVAGAALAAPVVGQHNVIDPWIRGNFVQAPNGEFTVSPRNSPGEVLLNLELGPELNPYLAHLARMYNGYAGGMEVQVVLAGNAFAAGKIIFAAVPPSFPVDALSAPTITMCPHVIVDVRQLEPVLLPMPDVRNNFFHYNQSSDPKLRLVAMLYTPLRANSPTDDVFTVSCRVLTRPSPDFEFTFLIPPTVESKSKPFTIPQLTLSELSNSRFPAPIDMLYTSPNDNIVVQPQNGRCTLDGELQGTTQLQPSLICSFRGVTLNETSRMLVDQEEEEEGEVQRPQARAFNHEYHLQLQNLDGTDYDPAGDLPATLGAPDFIGTVYGVVSQRTTRDSAARAHEAKITTSDPRYAPKLGSVEFVTESTDIVLNDQTKFTPVGLAHNRAVDYKQWELPHYAGELTANTNLAPPVAPVYPGEQLLFFRSNLPLAGGTAASVLDCLLPQEWIQHFYQESFAPQSDIALLRYVNPDTGRVLFEAKLHRQGYITVAGAGTSPVAVPPNGYFRFESWVSQFYTLAPMGSGTGRRRNQ

SEQ ID NO: 1550 - protein, 557 aa, Artificial Sequence
  capsid_protein__Norovirus__AAX32880
MMMASNDATAPTDGAAGLVPEVTNETMALEPVAGAALAAPVVGQHNVIDPWIRGNFVQAPNGEFTVSPRNSPGEVLLNLELGPELNPYLAHLARMYNGYAGGMEVQVVLAGNAFAAGKIIFAAVPPSFPVDALSAPTITMCPHVIVDVRQLEPVLLPMPDVRNNFFHYNQSSDPKLRLVAMLYTPLRANSPTDDVFTVSCRVLTRPSPDFEFTFLIPPTVESKSKPFTIPQLTLSELSNSRFPAPIDMLYTSPNDNIVVQPQNGRCTLGGELQGTTQLQPSLICSFRGVTLNETSRMLVDQEEEEEGEVQRPQARAFNHEYHLQLQNLDGTDYDPAGDLPATLGAPDFIGTVYGVVSQRTTRDSAARAHEAKITTSDPRYAPKLGSVEFVTESTDIVLNDQTKFTPVGLAHNRAVDYKQWELPHYAGELTANTNLAPPVAPVYPGEQLLFFRSNLPLAGGTAASVLDCLLPQEWIQHFYQESFAPQSDIALLRYVNPDTGRVLFEAKLHRQGYITVAGAGTSPVAVPPNGYFRFESWVSQFYTLAPMGSGTGRRRNQ

SEQ ID NO: 1551 - protein, 548 aa, Artificial Sequence
  capsid_protein__Norovirus__AAX32886
MKMASSDAAPSSDGSAGLVPEVNSETMALEPVVGAPLAAPVAGQHNIIDPWIKLNFVQAPNGEFTVSPRNAPGEILLDLELGPDLNPYLAHLSRMYNAYAGGMEVQVILAGNAFTAGKIIFAAVPPNFPLENLSAAQITMCPHIIVDVRQLEPVMLPMPDVRNRLFHYNQVREPRLRLVAYLYTPLRANNAGDDVFTVSCRVLTRPSQDFEFMFLVPPSVESKTKPFSLPNLTLAELSNSRFPLPIEQLYTNPLDNLVVQPQNGRCTIDGILLGTTQLVPSLICSMRGTLEADQASGHTDDESVQSRAFNRQRSLMLENPDGSAFDPSDEVPAVLGVPDFRGVVFGVLSQRNNGDTTRSHEAKIDTRRPRYAPKLGFVEVLTESDDFQNGPPTKFTPVGLGGDGNPDFQQWALPDYGGALTNNTNLAPPVVPVYPGEQILFFRSQLPSSGGTVAGWLDCLLPQEWIQHFYQDSAAAQSDVALVRYINPATGRVLFEAKLHRQGFLTVSAAGPHPVVAPADGYFRFESWVNQFYTLAPMGNGSGRRRVY

SEQ ID NO: 1552 - protein, 540 aa, Artificial Sequence
  capsid_protein__Norovirus__AAZ31376
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEVLSPSQVTMFPHIIVDVRQLEPVLIPLPDVRNNLYHYNQSNDPTIRLIAMLYTPLRANNAGDDVFTVSCRVLTRPSPDFDFMFLVPPTVESRTKPFSVPILTVEEMTNSRFPIPLEKLFTGPSSAFVVQPQNGRCTTDGVLLGTTQLSPVNICTFRGDVTHIAGAQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWINQFYTLAPMGNGAGRRRAL

SEQ ID NO: 1553 - protein, 540 aa, Artificial Sequence
  capsid_protein__Norovirus__AAZ31396
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEVLSPSQVTMFPHIIVDVRQLEPVLIPLPDVRNNLYHYNQSNDPTIRLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1554 - protein, 540 aa, Artificial Sequence
  capsid_protein__Norovirus__AAZ31402
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLLDVRNNLYHYNQSNDPTIKLIAMLYTPLRANNAGEVVFTVSCRVLTRPSPDFDFIFLVPPTVESRTKPFTVPILTAEEMTNSRFPTPLGKLFTGPSSAFVVQPQNGRCATDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGGVQFTTDTNNDFETGQNTKFTPVGVIQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDAGRVLFECKPHKSGYVTVAHTGQHDLVIPPNGYFRFDSWVNQFCTLAPMGNGTGRRRAL

SEQ ID NO: 1555 - protein, 539 aa, Artificial Sequence
  capsid_protein__Norovirus__AAZ31411
MKMASNDANPSDGSAANLVPEVNNEVMALEPVVGAAIAAPVAGQQNVIDPWIRNNFVQAPGGEFTVSPRNAPGEILWSAPLGPDLNPYPSHLARMYNGYAGGFEVQVILAGNAFTAGKIIFAAVPPNFPTEGLSPSQVTMFPHIIVDVRQLDPVLIPSPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWINYDPTEEIPAPLGTPDFVGKIQGMLTQTTREDGSTRAHKATVSTGSVHFTPKLGSVQYTTDTNNDFQTGQDTKFTPVGVIQDGNNHQNEPQQWVLPNYSGRTGHNVHLAPAVAPTFPGEQLLFFRSTMPGCSGYPNMNLDCLLPQEWVQHFYQEAAPAQPDVALLRFVNPDTGRVLFECKLHKSGYVTVAHTGPHDLVIPPNGYFRFDSWVNQFYTLAPMGNGAGRRRAL

SEQ ID NO: 1556 - protein, 548 aa, Artificial Sequence
  capsid_protein__Norovirus__AAZ31423
MKMASSDATPSNDGAAGLVPEIDNEAMALDPVAGAAIAAPLTGQQNIIDLWIMNNFVQAPGGEFTVSPRNSPGEVLLNLELGPEINPYLAHLARMHNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLLTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDREADFQQWSLPDYSGQFTHNMNLAPAVAPNLPGEQLLFFRSQLPSSGGRSTGILDCLVPQEWVQHFYQESAPAQTQVALVRYINPDTGRVLFEAKLHKLGFMTIAKNGDSPITVPPNGYFRFESWVNPFYTLAPMGTGSGRRRIQ

SEQ ID NO: 1557 - protein, 540 aa, Artificial Sequence
  capsid_protein__Norovirus__AAZ31428
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHPSGMEEQIVLAGNAFTAGKIIFAAIPPGFPYENLSPSHMTMCPHVIIYVIQLEPVLMLMPEIQNNFFHYNQGNDPKLRLVAMLYTPLRANNSGDDVFTVSCRVLTKPSPDFEFTFLVPPTVESKTKEFTLPILRISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEVNINTGGDQYAPKLAQVKFFSESQDFEVHQPTVFTPVGVAGDTSHPFRQWVLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRVQ

SEQ ID NO: 1558 - protein, 541 aa, Artificial Sequence
  capsid_protein__Norovirus__ABB02420
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGQVATFTMIEQDGSAYVPGDRAAPLGYPDYSGQLEIEVQTETTKAGDKLKVTTFEMILGPTTNVDQAPYQGRAYASLTAVASLDLVDGRVRAVPRSIYSFQDVLPEYNDGLLVPLAPPLGPFLPGEVLLRFRTYMRQLDTADAAAQPIDCALPQEFISWFASNSFTVQSDALLVRYRNTLTGQLLFEAKLYSEGYIAVSYSGSGPLTFPTDGFFEVVSWVPRLFQLASVGSLATGRTLKQ

SEQ ID NO: 1559 - protein, 541 aa, Artificial Sequence
  capsid_protein__Norovirus__ABB02423
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPASDFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTMIEQDGSAYVPGDRAAPLGYPDFSGQLEIEVQTETTKTGDKLKVTTFEMILGPTTNVDQAPYQGRAYASLTAAASLDLVDGRVRAVPRSVYSFQDELPEYNDGLLVPLAPPLGPFLPGEVLLRFRTYMRQLDTADASAQPIDCALPQEFISWFASNNFTVQSDALLVRYRNTLTGQLLFEAKLYSEGYIAVSYSGSGPLTFPTDGFFEVVSWVPRLFQLASVGSLVTGRTLKQ

SEQ ID NO: 1560 - protein, 540 aa, Artificial Sequence
  capsid_protein__Norovirus__ABC96746
MKMASNDASSSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDFETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1561 - protein, 539 aa, Artificial Sequence
  capsid_protein__Norovirus__ABD77588
MKMASNDASPSDGSTANLVPEVNNEVMALEPVVGAAIAAPVAGQQNVIDPWIRNSSVQAPGGEFTVSPRDAPGEILWSAPLGPDLNPYLSHLARMYNGYAGGFEVQVILAGNAFTAGKIIFAAAPPNFPTEGLSPSQVTMFPHIIVGVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLENCSRVPAVPLSSNHKMQCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1562 - protein, 540 aa, Artificial Sequence
  capsid_protein__Norovirus__ABD77589
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLDSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1563 - protein, 548 aa, Artificial Sequence
  capsid_protein__Norovirus__ABD77590
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSKLRLVAMLYTPLRANNSGDDVFTVSCRVLTRPSPDFSFNFLVPPTVESKTKPFTLPILTISEMSNSRFPVPIDSLHTSPTENISVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEENFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1564 - protein, 541 aa, Artificial Sequence
  capsid_protein__Norovirus__ABG45845
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPANPQWQNGRVHVDGTLLGTTPVSGSWVSCFAAEAAYEFQSGTGEVATFTLIEQDGSAYVPGDRAAPLGYPDFSGQLEIEVQTETTKTGDKLTVTTFEMILGPTTNVDQAPFQGRAYASLTAAASLDLVDGRVRAVPRSIYSFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLTFPTDGFFEVVSWVPRLYQLASVGSLATGRTLKQ

SEQ ID NO: 1565 - protein, 541 aa, Artificial Sequence
  capsid_protein__Norovirus__ABG45847
MRMSDGAAPKANGSEASGQDLVPTALEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPANPQWQNGRVHVDGTLLGTTPVSGSWVSCFAAEAAYEFQSGTGEVAAFTLIEQDGSAYVPGDRAAPLGYPDFSGQLEIEVQTETTKTGDKLTVTTFEMILGPTTNVDQAPFQGRVYASLTAAASLDLVDGRVRAVPRSIYGFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLTFPTDGFFEVVSWVPRLYQLASVGSLATGRTLKQ

SEQ ID NO: 1566 - protein, 541 aa, Artificial Sequence
  capsid_protein__Norovirus__ABG45849
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPRGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVGPSLPANPQWQNGRVHVDGTLLGTTPVSGSWVSCFAAEAAYEFQSGTGEVAAFTLIEQDGSAYVPGDRAAPLGYPDFSGQLEIEVQTETTKTGDKLTVTTFEMILGPTTNVDQAPFQGRVYASLTAAASLDLVDGRVRAVPRSIYGFQDVIPEYNDGLLVPLAPPIGPFLPGEVLLRFRTYMRQIDSSDAAAEAIDCALPQEFISWFASNAFTVQSEALLLRYRNTLTEQLLFECKLYSEGYIALSYSGSGPLTFPTDGFFEAVSWVPRLYQLASVGSLATGRTLKQ

SEQ ID NO: 1567 - protein, 541 aa, Artificial Sequence
  capsid_protein__Norovirus__ABG45851
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVAVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPANPQWQNGRVHVDGTLLGTTPVSGSRVSCFAAEAAYEFQSGTGEVATFTLIEQDGSAYVPGDRAAPLGYPDFSGQLEIEVQTETTKTGDKLTVTTFEMILGPTTNVDQAPFQGRAYASLTAAASLDLVDGRVRAVPRSIYSFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLTFPTDGFFEVVSWVPRLYQLASVGSLATGRTLKQ

SEQ ID NO: 1568 - protein, 541 aa, Artificial Sequence
  capsid_protein__Norovirus__ABI95835
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPANPQWQNGRVHVDGTLLGTTPVSGSWVSCFAAEAAYEFQSGTGEVATFTLIEQDGSAYVPGDRAAPLGYPDFSGQLEIEVQTETTKTGDKLTVTTFEMILGPTTNVDQAPFQGRAYASLTAAASLDLVDGRVRAVPRSIYSFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLIFPTDGFFEVVSWVPRLYQLASVGSLATGRTLKQ

SEQ ID NO: 1569 - protein, 539 aa, Artificial Sequence
  capsid_protein__Norovirus__ABI97981
MKMASNDANPSDGSTANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1570 - protein, 541 aa, Artificial Sequence
  capsid_protein__Norovirus__ABP99038
MRMSDGAAPKANGSEASGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPALQPRLCTHARWPAPVYGLLVDPSLPSSPQWQNGRVHVDGTLLGTTPVSGSWVSCFAAEAAYEFQSGTGEVATSTLIEQDGSAYVPGERAAPLGYPDFSGQLEIEVQTETTKAGDKLRVTTFEMILGPTTNVDQAPYQGRVYASLTAAASLDLVDGRVRAVPRSIYGFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYSGSGPLAFPTDGFFEVVSWVPRLYQLASVGSLATGRTLKQ

SEQ ID NO: 1571 - protein, 541 aa, Artificial Sequence
  capsid_protein__Norovirus__ABP99041
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTMIEQDGSAYVPGDRAAPLGYPDFSGQLEIEVQTETTKAGDKLKVTTFDMILGPTTNVDQAPYQGRAYASLTAAASLDLVDGRVRAVPRSIYSFQDELPEYNDGLLVPLAPPLGPFLPGEVLLRFRTYMRQLDTADASAQPIDCALPQEFISWFASNNFTVQSDALLVRYRNTLTGQLLFEAKLYSEGYIAVSYSGSGPLTFPTDGFFEVVSWVPRLFQLASVGSLATGRTLKQ

SEQ ID NO: 1572 - protein, 540 aa, Artificial Sequence
  capsid_protein__Norovirus__ABQ12784
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTPQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1573 - protein, 578 aa, Artificial Sequence
  capsid_protein__Norovirus__ABR15783
MKMASSDATPSSDGAGNLVPESQQEVLPLAPVAGAALAAPVVGQQNIIDPWIKENFVQAPQGEFTVSPKNSPGEVLVNLELSPRLNPYLHHLSKMYNAYAGGMEVEIILAGNAFTAGKVLIAAVPPNFPIENVSASQASQFPHVIVDVRTLEPIRLPLPDVRTNFFHYTTQEEPRMRIVAWLYTPLRTNGSGDDSFTVSGRILTRPSPDFEFSFLVPPTVETKTVSFSVPGLVVQDMSNSRWPAQISGLVVRGNEAQVVHFQNGRCTTEGMLLGTTTLNINSICGLRGLSVSQASVRGAPALTEEMPPLEDEVADGAAATYTLTRAADTALWLRVEEPDGRPYDIFGDQPAPLGTPDFTAVIVGTAIRPRTTSGAYLHDAYVDTTPGDADFTPSTGNTKIVLRGGGSGHVGQGHYWQFKPIAVEGGGSRPQYQEYNLPDYAGPTASNHDLAPPVAPRMPGELLLLFESDMPVWDNGAGAAPAQKIHCLLPNEFITHLFDLQAPALAEAALLRYVHPDSGRTLFECKLYREGYMVVAAPVGRLNFPLDGYFRFDSWVSAFYVLSPVGSGQGRRGRSKAA

SEQ ID NO: 1574 - protein, 268 aa, Artificial Sequence
  capsid_protein__Norovirus__ABR24136
MAGAFFAGLASDVLGSGLGSLINAGAGAINQKVEFENNRKLQQASFEFSSNLQQASFQHDKEMLQAQIEATKKLQQGMMKVKQAMLLEGGFSETDAARGAINAPMTKALDWSGTRYWAPDARTTTYNAGRFSTPQPSGALPGRTNPRATVPARGSPSTPSNTSTVTSVYSDQTVSTRLGSTAGSGTRVSSLPSTARTRSWVEDQNRNLSPFMRGAHNISFVTPPASRSSSQGTVSTVPKEVLDSWTGAFNTRRQPLFAHIRKRGESRA

SEQ ID NO: 1575 - protein, 548 aa, Artificial Sequence
  capsid_protein__Norovirus__ABS12173
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRPSDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1576 - protein, 536 aa, Artificial Sequence
  capsid_protein__Norovirus__ABS12175
MKMASNDATPSDDGAAGLVPEINSEVMALEPVAGASLAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAMLYGVASQRSSRDNATRAHDAQIDTAGDTFAPKIGQVRFKSSSNDFDLHDPTKFTPIGVNVDDQHPFRQWFLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 1577 - protein, 541 aa, Artificial Sequence
  capsid_protein__Norovirus__ABS29273
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPIYGLLVDPSLPSNPQWQNGRVHVDGTLLGTTPISGSWVSCFAAEAAYEFQSGIGEVATFTLIEQDGSAYVPGDRAAPLGYPDFSGQLEIEVQTETTKTGDKLKVTTFEMILGPTTNADQAPYQGRVFASVTAAASLDLVDGRVRAVPRSVYSFCDTIPEYNDGLLVPLAPPIGPFLPGEVLLRFRTYMRQLDTADAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1578 - protein, 541 aa, Artificial Sequence
  capsid_protein__Norovirus__ABS29275
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYEFQSGIGEVATFTLIEQDGSAYIPGDRAAPLGYPDFSGQLEIEVQTETTKTGDKLKVTTFEMVLGPTTNVDQAPYQGRVYASVTAAASLDLVDGRVRAVPRSIYSFQDTIPEYNDGLLVPLAPPIGPFLPGEVLLRFRTYMRQLDTADAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1579 - protein, 541 aa, Artificial Sequence
  capsid_protein__Norovirus__ABU55541
MRMSDGAAPKANGSEASGQDLVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYKFQSGTGEVATFTLIEQDGSAYVPGDRAAPLGYPDFSGQLEIEVQTETTKTGDKLKVTTFEMILGPTTNADQAPYQGRVFASVTAAASLDLVDGRVRAVPRSIYGFQDTIPEYNDGLLVPLAPPIGPFLPGEVLLRFRTYMRQIDTADAAAEAIDCALPQEFVSWFASNAFTVQSEALLLRYRNTLTGQLLFECKLYNEGYIALSYSGSGPLTFPTDGIFEVVSWVPRLYQLASVGSLATGRMLKQ

SEQ ID NO: 1580 - protein, 541 aa, Artificial Sequence; identical to SEQ ID NO: 1579
  capsid_protein__Norovirus__ABU55544

SEQ ID NO: 1581 - protein, 541 aa, Artificial Sequence
  capsid_protein__Norovirus__ABU55547
MRMSDGAAPKANGSEASGQDLVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYKFQSGTGEVATFTLIEQDGSAYVPGDRAAPLGYPDFSGQLEIEVQTETTKTGDKLKVTTFEMILGPTTNADQAPYQGRVFASVTAAASLDLVDSRVRAVPRSIYGFQDTIPEYNDGLLVPLAPPIGPFLPGEVLLRFRTYMRQIDTADAAAEAIDCALPQEFVSWFASNAFTVQSEALLLRYRNTLTGQLLFECKLYNEGYIALSYSGSGPLTFPTDGIFEVVSWVPRLYQLASVGSLATGRMLKQ

SEQ ID NO: 1582 - protein, 541 aa, Artificial Sequence; identical to SEQ ID NO: 1579
  capsid_protein__Norovirus__ABU55550

SEQ ID NO: 1583 - protein, 541 aa, Artificial Sequence; identical to SEQ ID NO: 1579
  capsid_protein__Norovirus__ABU55553

SEQ ID NO: 1584 - protein, 541 aa, Artificial Sequence
  capsid_protein__Norovirus__ABU55556
MRMSDGAAPKANGSDASGQDLVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYKFQSGTGEVATFTLIEQDGSAYVPGDRAAPLGYPDFSGQLEIEVQTETTKTGDKLKVTTFEMILGPTTNADQAPYQGRVFASVTAAASLDLVDGRVRAVPRSIYGFQDTIPEYNDGLLVPLAPPIGPFLPGEVLLRFRTYMRQIDTADAAAEAIDCALPQEFVSWFASNAFTVQSEALLLRYRNTLTGQLLFECKLYNEGYIALSYSGSGPLTFPTDGIFEVVSWVPRLYQLASVGSLATGRMLKQ

SEQ ID NO: 1585 - protein, 541 aa, Artificial Sequence
  capsid_protein__Norovirus__ABU55559
MRMSDGAAPKANGSEASGQDLVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYEFQSGTGEVATFTLIEQDGSAYVPGDRAAPLGYPDFSGQLEIEVQTETTKTGDKLKVTTFEMILGPTTNADQAPYQGRVFASVTAAASLDLVDGRVRAVPRSIYGFQDTIPEYNDGLLVPLAPPIGPFLPGEVLLRFRTYMRQIDTADAAAEAIDCALPQEFVSWFASNAFTVQSEALLLRYRNTLTGQLLFECKLYNEGYIALSYSGSGPLTFPTDGIFEVVSWVPRLYQLASVGSLATGRMLKQ

SEQ ID NO: 1586 - protein, 541 aa, Artificial Sequence; identical to SEQ ID NO: 1579
  capsid_protein__Norovirus__ABU55562

SEQ ID NO: 1587 - protein, 541 aa, Artificial Sequence; identical to SEQ ID NO: 1579
  capsid_protein__Norovirus__ABU55565

SEQ ID NO: 1588 - protein, 541 aa, Artificial Sequence
  capsid_protein__Norovirus__ABU55568
MRMSDGAAPKANGSEASGQDFVPAAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLIDPSLPSNPQWQNGRVHVNGTLLGTTPVSGSWVSCFAAEAAYEFQSGIGEVATFTMIEQDGSAYVPGDRAAPLGYPDFSGQLEIEVQTETTKSGDKLKVTTFEMILGPTTNADQTPYQGKVYASIAAAASLDLVDGRVRAVPRSVYAFQDVLPEYNDGLLVPLAPPLGPFLPGEVLLRFRTYVRQLDTADAAAQPIDCALPQEFISWFASNNFTVQSDALLIRYRNTLTGQLLFEAKLYSEGYIAVSYSGSGPLTFPTDGFFEVVSWVPRLFQLASVGSLATGRTLKQ

SEQ ID NO: 1589 - protein, 541 aa, Artificial Sequence
  capsid_protein__Norovirus__ABU55571
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTVYRMVDLPVLQPRLCTHARWPAPIYGLLIDPSLPSNPQWQNGRVHVNGTLLGTTPVSGSWVSCFAAEAAYEFQSGTGEVATFTMIEQDGSAYVPGDRAAPLGYPDFSGQLEIEVQTETTKTGDKLKVTTFEMVLGPTTNVDQAPYQGRTYASLTAAASLDLVDGRVRAVPRSIYSFQDVLPEYNDGLLVPLAPPLGPFLPGEVLLRFRTYMRQLDTADAAAQPIDCALPQEFISWFASNNFTVQSDALLIRYRNTLTGQLLFEAKLYSEGYIAVSYSGSGPLTFPTDGFFEVVSWVPRLFQLASVGSLATGRTLKQ

SEQ ID NO: 1590 - protein, 541 aa, Artificial Sequence
  capsid_protein__Norovirus__ABU55577
MRMSDGAAPKANGSEAIGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLVDPSLPSNPQWQNGRVHVNGTLLGTTPVSGSWVSCFAAEAAYEFQSGTGEVATFTMIEQDGSAYVPGDRAAPLGYPDFSGQLEIEVQTETTKSGDKLKVTTFEMILGPTTNADQTPYQGRVYASIAAAAPLDLVDGRVRAVPRSVYFFQDVLPEYNDGLLVPLAPPLGPFLPGEVLLRFRTYVRQLDTADAAAQPIDCALPQEFISWFASNSFTVQSEALLIRYRNTLTGQLLFEAKLYSEGYIAVSYSGSGPLTFPTDGFFEVVSWVPRLFQLASVGSLATGRTLKQ

SEQ ID NO: 1591 - protein, 541 aa, Artificial Sequence
  capsid_protein__Norovirus__ABU55580
MRMSDGAAPKANGSEAIGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLVDPSLPSNPQWQNGRVHVNGTLLGTTPVSGSWVSCFAAEAAYEFQSGTGEVATFTMIEQDGSAYVPGDRAAPLGYPDFSGQLEIEVQTETTKSGDKLKVTTFEMILGPTTNADQAPYQGRVYASLAAAAPLDLVDGRVRAVPRSVYFFQDVLPEYNDGLLVPLAPPLGPFLPGEVLLRFRTYVRQLDTADAAAQPIDCALPQEFISWFASNSFTVQSEALLIRYRNTLTGQLLFEAKLYSEGYIAVSYSGSGPLTFPTDGFFEVVSWVPRLFQLASVGSLATGRTLKQ

SEQ ID NO: 1592 - protein, 541 aa, Artificial Sequence
  capsid_protein__Norovirus__ABU55586
MRMSDGAAPKANGSEAIGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLVDPSLPSNPQWQNGRVHVNGTLLGTTPVSGSWVSCFAAEAAYEFQSGTGEVATFTMIEQDGSAYVPGDRAAPLGYPDFSGQLEIEVQTETTKSGDKLKVTTFEMILGPTTNADQAPYQGKVYASLAAAAPLDLVDGRVRAVPRSVYFFQDVLPEYNDGLLVPLAPPLGPFLPGEVLLRFRTYVRQLDTADAAAQPIDCALPQEFISWFASNSFTVQSDALLIRYRNTLTGQLLFEAKLYSEGYIAVSYSGSGPLTFPTDGFFEVVSWVPRLFQLASVGSLATGRTLKQ

SEQ ID NO: 1593 - protein, 541 aa, Artificial Sequence
  capsid_protein__Norovirus__ABU55589
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLIDPSLPSNPQWQNGRVHVNGTLLGTTPVSGSWVSCFAAEAAYEFQSGTGEVATFTMIEQDGSAYVPGDRAAPLGYPDFSGQLEIEVQTETTKSGDKLRVTTFEMILGPTTNVDQAPYQGRVYASLAAAASLDLVDGRVRAVPRSVYSFQDVLPEYNDGLLVPLAPPLGPFLPGEVLLRFRTYMRQLDTADAAAQPIDCALPQEFISWFASNNFTVQSDALLIRYRNTLTGQLLFEAKLYSEGYIAVSYSGSGPLTFPTDGFFEVVSWVPRLFQLASVGSLATGRTLKQ

SEQ ID NO: 1594 - protein, 541 aa, Artificial Sequence
  capsid_protein__Norovirus__ABU55598
MRMSDGAAPKASGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHIDGTLLGTTPVSGSWVSCFAAEAAYEFQSGTGEVATFTLIEQDGSAYVPGDRAAPLGYPDFSGQLEIEVQTETTRAGDKLKVTTFEMILGPTTNVDQAPYQGRVYASLTAAASLDLVDGRVRAVPRSIYSFQDVLPEYNDGLLVPLAPPIGPFLPGEVLLRFRTYMRQVDSSDAAAEAIDCALPQEFVSWFASNGFTVQSEALLLRYRNTLTGQLLFECKLYSEGYIALSYSGSGPLTFPTDGFFEVVSWVPRLFQLASVGSLVTGRTLKQ

SEQ ID NO: 1595 - protein, 541 aa, Artificial Sequence
  capsid_protein__Norovirus__ABU55601
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMADLPVLQPRLCTHARWPAPVYGLLVDPSLPSNPQWQNGRVHVDGTLLGTTPISGSWVSCFAAEAAYEFQSGTGEVATLTLIEQDGSAYVPGDRAAPLGYPDFSGQLEIEVQTETTKAGDKLKVTTFDMILGPTTNVDQAPYQGRVYASVSTAASLGLVDGRVRAVPRSIYGFQDTIPEYNDGLLVPLAPPIGPFLPGEVLLRFRTYMRQIDTADAAAEAIDCALPQEFISWFASNAFTVQSEALLLRYRNTLTGQLLFECKLYSEGYIALSYSGSGPLTFPTDGFFEAVSWVPRLYQLASVGSLATGRTLKQ

SEQ ID NO: 1596 - protein, 541 aa, Artificial Sequence
  capsid_protein__Norovirus__ABU55604
MRMSDGAAPRANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPIYGLLVDPSLPSNPQWQNGRVHVDGTLLGTTPISGSWVSCFAAEAAYEFQSGTGEVATFTLIEQDGSAYVPGDRAAPLGYPDFSGQLEIEVQTETTKTGDKLKVTTFEMILGPTTNVDQAPYQGRVYASVAAAASLDLVDGRVRAVPRSIYGFQDVIPEYNDGLLVPLAPPIGPFLPGEVLLRFRTYMRQLDTADAAAEAIDCALPQEFVSWFASNAFTVQSEALLLRYRNTLTGQLLFECKLYSEGYIALSYSGSGPLTFPADGFFEVVSWVPRLYQLASVGSLATGRMLRQ

SEQ ID NO: 1597 - protein, 541 aa, Artificial Sequence
  capsid_protein__Norovirus__ABU55607
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAPDFNFVYLTPPIERTIYRMVDLPVLQPRLCTHARWPAPVYGLLVDPSLPSNPQWQNGRVQVDGTLLGTTPVSGSWVSCFAAEAAYEFQAGTGEVVTFTMIEQDGSAYVPGDRAAPLGYPDFSGQLEIEVQTETTKTGDKLRVTTFEMILGPTTNVDQAPYQGRAYASLTAAASLDLVDGRVRAVPRSIYSFQDELPEYNDGLLVPLAPPLGPFLPGEVLLRFRTYMRQLDTADAAAQPIDCALPQEFISWFASNNFTVQSDALLVRYRNTLTGQLLFEAKLYSEGYIAVSYSGSGPLTFPTDGFFEVVSWVPRLFQLASVGSLVTGRTLKQ

SEQ ID NO: 1598 - protein, 541 aa, Artificial Sequence
  capsid_protein__Norovirus__ABU55610
MRMSDGAAPKANGSEASGQDLVPTAVEQAVPIQPVAGAALAAPAAGQINQIDPWIFQNFVQCPLGEFSVSPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPSDESFVVSGRLLSKPAADFNFVYLTPPIERTIYRMVDLPVLQPRLCTHARWPAPVYGLLVDPSLPSNPQWQNGRVHVDGTLLGTTPISGSWVSCFAAEAAYEFQSGTGEVATFTLVEQDGSAYVPGDRAAPLGYPDFSGQLEIEVQTETTKPGEKLKVTTFEMILGPTTNVDQAPYRGKVFASITTAASLSLVDGRVRAVPRSIYSFQDVIPEYNDGLLVPLAPPIGPFLPGEVLLRFRTYMRQLDSADAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1599 - protein, 541 aa, Artificial Sequence
  capsid_protein__Norovirus__ABU55613
MRMSDGAAPKANGSEASGQDLVPTAVEQAVPIQPVAGSALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKTGDKLKVTTFEMILGPTTNVDQAPYQGRVYASLTAVASLDLVDGRVRAVPRSIYGFQDVIPEYNDGLLVPLAPPIGPFLPGEVLLRFRTYMRQLDTADAAAEAIDCALPQEFISWFASNAFTVQSDALLLRYRNTLTGQLLFECKLYSEGYIALSYSGSGPLTFPTDGFFEVVSWVPRLFQLASVGSLTTGRTLKQ

SEQ ID NO: 1600 - protein, 541 aa, Artificial Sequence
  capsid_protein__Norovirus__ABU55616
MRMSDGAAPKANGSEASGQDLVPTAIEQAVPIQPVAGSALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKTGDKLKVTTFEMILGPTTNVDQAPYQGKVYASLAVAASLDLVDGRVRAVPRSIYGFQDVIPEYNDGLLVPLAPPIGPFLPGEILLRFRTYMRQLDTADAAAEAIDCALPQEFISWFASNAFTVQADALLLRYRNTLTGQLLFECKLYSEGYIALSYSGSAPLTFPTDGFFEVVSWVPRLFQLASVGSLTTGRTLKQ

SEQ ID NO: 1601 - protein, 541 aa, Artificial Sequence
  capsid_protein__Norovirus__ABU55619
MRMSDGAAPKANGSEASGQDLVPTAVEQAVPIQPVAGSALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGQVATFTLIEQDGSAYVPGDRAAPLGYPDFSGQLEIEVQTETTKAGDKLKVTTFEMILGPTTNVDQAPYQGRVYASLAVAASLDLVDGRVRAVPRSIHGFQDVIPEYNDGLLVPLAPPIGPFLPGEVLLRFRTYMRQLDTADAAAEAIDCALPQEFISWFASNAFTVQSDALLLRYRNTLTGQLLFECKLYSEGYIALSYSGSGPLTFPTDGFFEVVSWVPRLFQLASVGSLATGRTLKQ

SEQ ID NO: 1602 - protein, 541 aa, Artificial Sequence
  capsid_protein__Norovirus__ABU55622
MRMSDGATPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTHARWPAPVYGLLVDPSLPSNPQWQNGRVHVDGTLLGTTPISGSWVSCFAAEAAYEFQSGTGEVATFTLIEQDGSAYVPGDRAAPLGYPDFSGQLEIEVQTETTKTGDKLKVTTFEMILGPTTNVDQAPYQGRVFASVTAAASLDLVDGRVRAVPRSIYGFQDTIPEYNDGLLVPLAPPIGPFLPGEVLLRFRTYMRQLDTADAAAEAIDCALPQEFVSWFASNAFTVQSEALLLRYRNTLTGQLLFECKLYSEGYIALSYSGSGSLTFPTDGFFEVVSWVPRLYQLASVGSLATGRTLKQ

SEQ ID NO: 1603 - protein, 540 aa, Artificial Sequence
  capsid_protein__Norovirus__ABU55628
MRMSDGAVPKANGSEASGQDLVPTAVEQAVPIQPVAGASIAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKTGEKLKVTTFEMILGPATNVDQAPFQGRVYASLTAVASLDLVDGRVRAVPRSIYAFQDVIPEYNDGLLVPLAPPIGPFLPGELLLRFRTYMRQIDSSDAAAEAIDCALPQEFISWFASNAFTVQSEALLLRYRNTLTGQLLFECKLYSEGYIALSYSGSGPLTFPADGFFEVVSWVPRLFQLASVGSSATGRTLK

SEQ ID NO: 1604 - protein, 530 aa, Artificial Sequence
  capsid_protein__Norovirus__ABW74121
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGSGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGINSGNYIGVLSWVSPPSHPSGSQVDLWKIPNYGSSITEATHLAPSVFPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTASTARGRLGLRR

SEQ ID NO: 1605 - protein, 530 aa, Artificial Sequence
  capsid_protein__Norovirus__ABW74123
MMMASKDATSSVDGASGAGQLVPEVNASDPLAMDPVAGSSTAVATAGQVNPIDPWIINNFVQAPQGEFTISPNNTPGDVLFDLSLGPHLNPFLLHLSQMYNGWVGNMRVRIMLAGNAFTAGKIIVSCIPPGFGSHNLTIAQATLFPHVIADVRTLDPIEVPLEDVRNVLFHNNDRNQQTMRLVCMLYTPLRTGGGTGDSFVVAGRVMTCPSPDFNFLFLVPPTVEQKTRPFTLPNLPLSSLSNSRAPLPISGMGISPDNVQSVQFQNGRCTLDGRLVGTTPVSLSHVAKIRGTSNGTVINLTELDGTPFHPFEGPAPIGFPDLGGCDWHINMTQFGHSSQTQYDVDTTPDTFVPHLGSIQANGINSGNYIGVLSWVSPPSHPSGSQVDLWKIPNYGSSITEATHLAPSVFPPGFGEVLVFFMSKIPGPGAYSLPCLLPQEYISHLASEQAPTVGEAALLHYVDPDTGRNLGEFKAYPDGFLTCVPNGASSGPQQLPINGVFVFVSWVSRFYQLKPVGTASTARGRLGLRR

SEQ ID NO: 1606 - protein, 530 aa, Artificial Sequence; identical to SEQ ID NO: 1605
  capsid_protein__Norovirus__ABW74124

SEQ ID NO: 1607 - protein, 530 aa, Artificial Sequence; identical to SEQ ID NO: 1605
  capsid_protein__Norovirus__ABW74125

SEQ ID NO: 1608 - protein, 530 aa, Artificial Sequence; identical to SEQ ID NO: 1605
  capsid_protein__Norovirus__ABW74126

SEQ ID NO: 1609 - protein, 530 aa, Artificial Sequence; identical to SEQ ID NO: 1605
  capsid_protein__Norovirus__ABW74127

SEQ ID NO: 1610 - protein, 530 aa, Artificial Sequence; identical to SEQ ID NO: 1605
  capsid_protein__Norovirus__ABW74128

SEQ ID NO: 1611 - protein, 539 aa, Artificial Sequence
  capsid_protein__Norovirus__ABW74532
MKMASSDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHVIVDVRQLEPVLIPLPDVRNNFYHYNQAHDPTIKLIAMLYTPLRANNAGDDVFTVSCRVLTRPSPDFDFIFLVPPTVESRTKPFTVPILTVEEMSNSRFPIPLEKLYTGPSSDFVVQPQNGRCTTDGVLLGTTQLSAVNICNFKGDVTHIAGSRDYRMNLVSQNWNNYDPTEEIPAPLGTPDFQGKIQGLLTQTTGADGSTRAHKATVSTGAANFTPKLGSVQFTTDTDNDFQTGQNTKFTPVGVIQDGSHHQNEPQQWVLPNYSGRTVHNVHLAPAVAPTFPGEQLLFFRSTMPGCSGYPNMNLDCLLPQEWVMHFYQEAAPAQSDVALLRFVNPDTGRVLFECKLHKAGYITVAHTGQHDLVIPPNGYFRFDSWVNQFYTLAPMGNGAGRRRAL

SEQ ID NO: 1612 - protein, 539 aa, Artificial Sequence
  capsid_protein__Norovirus__ABW74533
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTRGDGSTRAHKATVSTGSVHFTPKLGSVQFTTDTNNDFQTGQNTKFTPVGVIQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 1613 - protein, 540 aa, Artificial Sequence
  capsid_protein__Norovirus__ABW74534
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTRPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLSQTTRGDGSTRGHKATVSTGSVHFTPKLGSVQFTTDTNNDLETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1614 - protein, 540 aa, Artificial Sequence; identical to SEQ ID NO: 1504
  capsid_protein__Norovirus__ABW74535

SEQ ID NO: 1615 - protein, 539 aa, Artificial Sequence
  capsid_protein__Norovirus__ABW74536
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQAGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGTGRRRAL

SEQ ID NO: 1616 - protein, 540 aa, Artificial Sequence
  capsid_protein__Norovirus__ABW74537
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1617 - protein, 540 aa, Artificial Sequence
  capsid_protein__Norovirus__ABW74538
MKMASNDASPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDLETGQNTRFTPVGVVQDGNSTHQNEPQQWVLPNYSGRAGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1618 - protein, 540 aa, Artificial Sequence
  capsid_protein__Norovirus__ABW74539
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASQNWNNYDPTEEIPAPLGTPDFVGRIQGMLTQTTRRDGSTRGHKATVSTGDAHFTPKLGSIMFSTDTDNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1619 - protein, 540 aa, Artificial Sequence; identical to SEQ ID NO: 487
  capsid_protein__Norovirus__ABW74540

SEQ ID NO: 1620 - protein, 540 aa, Artificial Sequence
  capsid_protein__Norovirus__ABW74541
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPDYSGRNSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1621 - protein, 540 aa, Artificial Sequence
  capsid_protein__Norovirus__ABW74542
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1622 - protein, 540 aa, Artificial Sequence; identical to SEQ ID NO: 472
  capsid_protein__Norovirus__ABW74544

SEQ ID NO: 1623 - protein, 540 aa, Artificial Sequence; identical to SEQ ID NO: 1035
  capsid_protein__Norovirus__ABW74545

SEQ ID NO: 1624 - protein, 540 aa, Artificial Sequence
  capsid_protein__Norovirus__ABW74546
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFHQEAAPAQSDVALLRFVNPDTGRVLFECKLHKSGYVTVAHTGQHDLVIPPNGYFRFDSWVNQFYTLAPMGNGTGRRRAL

SEQ ID NO: 1625 - protein, 521 aa, Artificial Sequence
  capsid_protein__Norovirus__ABW75843
MKMSDKESAESPASLGQVLPPQVDVVVPVEPTVGAQIAAPTAGQINPIDPWIFSNFVQAPQGEFTISPNNNPGEILFEMELGPDLNPYLGHLRRMYNGWTGSLRVRVMLAGNAFSAGKIIVFCIPPGFDTTFLTPAQATQFPHVIMDVRAPDPVEVPLEDVRNVLFHQGPDNRMRLVGMLYTPLRANSGADPFVVTGRVLTCPSENFSFFFLVPPTVEEKDVPFTIPNVPTSSLTNSRMLEPVAELRSSRNFALSVQFQNGRSTIEGELLGTTPASLADLGSFLCIRGGTANLAELFQPNEDAFVAGSHPAPFGFPDFSNCTLDFLLYDANGLYHRHLDVTSASNFTPALGHITLDGSVPDRLTRARLEGVQRASENTFWRMPDYRGDVLGAEFAPAVSAPGIGETLLFFMSNVPYHNGSNPNPLPCLLPLEWINHFVAERPAKQSDVALLNYINPLTGRVLFECKLYSAGFLAVNLGSQTEVTLPVDGIFKFVSWVSYYYQLRPVGTVSVGRRLPRLDGH

SEQ ID NO: 1626 - protein, 578 aa, Artificial Sequence
  capsid_protein__Norovirus__ABX71062
MKMASNDAAPSSDGAGNLVPESHQEVLPLAPVAGAAIAAPVVGQQNIIDPWIKENFVQAPQGEFTVSPKNSPGEVLVNLELSPKLNPYLDHLSKMYNAYAGGMEIEIILAGNAFTAGKVLIAAVPPNFPVENISVSQASQFPHVIVDVRTLEPIRLPLPDVRTNFFHYTTRDEPKMRIVAWLYTPLRTNGSGDDSFTVSGRILTRPSADFEFSFLVPPTVETKTVSFSVPGLTVEEMSNSRWPAQINGLVVRGNEAQVVHFQNGRCTTEGMLLGTTTLNVNSICGLRGTSISHASVREAPALSEEMPPLEDEVAHGAAATYAVGRAADTTLWIRVEEPNGQPYDIFGEQPAPLGTPDFTAVIIGTAIRPRTASGAYLHDAYVDTRPGDADFTPSTGNTKIVLRGGGSGHVGEGHYWQFKPIAVEGGPNRPVYQEYNLPEYAGPTASNHNLAPPVAPKMPGELLLLFESDMPVWDNGSGSAPTQKIHCLLPNDFVTHFFDLQAPALAEAALLRYVHPDSGRTLFECKLYREGYMVVVAPSGRLDFPLDGYFRFDSWVNAFYVLSPVGNGQGRRGRAKNI

SEQ ID NO: 1627 - protein, 534 aa, Artificial Sequence
  capsid_protein__Norovirus__ABY77754
MKMASNDASPSSDGSANLVPEINNEVMALEPVAGAAIAAPVAGQQNIIDPWIRNNFVQAPGGEFTVSPRNAPGEVLLNLPLSPDINPYLAHLSRMYNGYAGGVEVEVVLAGNAFTAGKIIFAAVPPNFPPENLSPSQITMLPHIIVDVRQLEPVRIPLPDVRNNFYHYSRENDSTLRLVAMLYTPLRANNAGDDVFTVSCRVLTRPSPDFDFIFLVPPTVESKSKPFTIPILTIEEMTNSRFPAPLEMMTTGPSHDIVVQPQNGRCTIDGVLLGTTQLSPVNICSMRGVPTKRTNGTDNCFVQLENPNGSAYDPTEDIPAVLGSPDFVGEFYGTITQRSPNNSTRAHPFTLNTGSPRYTPKIGSVDIHVTDVDDLNDHEPVKLTPVGLSGSSGSIHQWQLPNYSGVATHNMHLAPSVAPLFPGEQILFFRSTVPGCGGYPNTNIDCLIPQEWVQHFYQEGAPARTDVALLRFINPDTGRVLFECKLHKHGFITVAYSGNHDLVMPPNGYFRFESWVNQFHTLAPMGTGRAEEIQ

SEQ ID NO: 1628 - protein, 535 aa, Artificial Sequence
  capsid_protein__Norovirus__ABZ89549
MKMASNDASPSSDGSANLVPEINNEVMALEPVAGAAIAAPVAGQQNIIDPWIRNNFVQAPGGEFTVSPRNAPGEVLLNLPLSPDINPYLAHLSRMYNGYAGGVEVEVVLAGNAFTAGKIIFAAVPPNFPPENLSPSQITMLPHIIVDVRQLEPVRIPLPDVRNNFYHYSRENDSTLRLIAMLYTPLRANNAGDDVFTVSCRVLTRPSPDFDFIFLVPPTVESKSKPFTIPILTIEEMTNSRFPAPLEMMTTGPSHDIVVQPQNGRCTIDGVLLGTTQLSPVNICSMRGVPTKRTNGTDNCFVQLENPNGSAYDPTEDIPAVLGSPDFVGEFYGTITQRSPNNSTRAHPFTLNTGSPRYTPKIGSVDIHVTDVEDLNDHEPVKLTPVGLSGSSGSIHQWQLPNYSGVATHNMHLAPSVAPLFPGEQILFFRSTVPGCGGYPNTNIDCLIPQEWVQHFYQEGAPARTDVALLRFVNPDTGRVLFECKLHKHGFITVAYSGNHDLVMPPNGYFRFESWVNQFHTLAPMGTGSGRRRIQ

SEQ ID NO: 1629 - protein, 547 aa, Artificial Sequence
  capsid_protein__Norovirus__ACC69023
MKMASNDAPPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEAQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPGLTLDELSNSRFPAPIVQLYTNPHDNLVVQPQNGRCTIDGLLQGTTQLVSCNVCSYRGTIGGGQPASHTEEEIMPMAFNIQREIMLENLDGSPYDPVDDIPAVLGSPDFQGVVFGILSQRNANGQTRAHEAKVDTRAARFAPKLGFVVATVESTDFHDNQPSRFAPVGLGGNGNQDFNQWALPAYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRAR

SEQ ID NO: 1630 - protein, 547 aa, Artificial Sequence
  capsid_protein__Norovirus__ACC69026
MKMASNDAPPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPGLTLDELSNSRFPAPIVQLYTNPHDNLVVQPQNGRCTIDGLLQGTTQLVSCNVCSFRGTIGGGQPASHSEEEIMPMAFNIQREIMLENLDGSPYDPADDIPAVLGSPDFQGVVFGILSQRNASGQTRAHEAKVDTRAARFAPKLGFVVATVESTDFHDNQPSRFTPVGLGGNGNQDFNQWALPAYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRAR

SEQ ID NO: 1631 - protein, 556 aa, Artificial Sequence
  capsid_protein__Norovirus__ACC69028
MKMASNDVAAPSTDGSAGLVPEVNNETMALEPVAGAALAAPVVGQHNVIDPWIRGNFVQAPNGEFTVSPRNSPGEVLLNLELGPELNPYLAHLARMYNGYAGGMEVQVVLAGNAFAAGKIIFAAVPPSFPVDALSAPTITMCPHVIVDVRQLEPVLLPMPDVRNNFFHYNQSSDPKLRLVAMLYTPLRANSPTDDVFTVSCRVLTRPSPDFEFTFLIPPTVESKSKPLTIPQLTLSELSNSRFPAPIDMLNTSPNDNIVVQPQNGRCTLDGELQGTTQLQPSLICSFRGVVLNETSRMAVDYEEEEEVQRPQARAFNHEYHLQLQNLDGTDYDPAGDLPATLGAPDFVGTVYGVVSQRTTRDSAARAHEAKIITNDPRYAPKLGSVEFVTESTDIVINDQTKFTPVGLAHNRAVDYKQWELPHYAGELTANTNLAPPVAPVYPGEQLLFFRSNLPLAGGTAASVLDYLLPQEWIQHFYQESFTPQSDIALLRYVNPDTGRVLFEAKLHRQGYITVAGAGTSPVAVPPNGYFRFESWVSQFYALAPMGSGTGRRRNQ

SEQ ID NO: 1632 - protein, 541 aa, Artificial Sequence
  capsid_protein__Norovirus__ACC96732
MGMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVIQPRLCTRARWPAPVYGLLVDPSLPSNPQWQNGRVHVDGTLLGTTPISGSWVSCFAAEAAYEFRSGTGEEVTFTLIEQDGSAYVPGDRAAPLGYPDFSGQLEIEVQTETTKTGDKLKVTTFEMILGPRTNVDQAPYQGRAYASVNATASLNLVDGRVRAVPRSIHSFQDVIPEYNDGLLVPLAPPIGPFLPSEVLLRFRTYMRQIDTADAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1633 - protein, 541 aa, Artificial Sequence
  capsid_protein__Norovirus__ACC96735
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPRGSLTTTQITCFPHVMCDVRTLEPIQLPLLDVRRVLWHATQDQEESMRLVCMLYTPLRTNSPGDESFVVSGRLLSKPAADFNFVYLTPPIERTIYRMVDLPVVQPRLCTHARWPAPIYGLLVDPSLPSNPQWQNGRVHVDGTLLGTTPISGSWVSCFAAEAAYEFQSGTGEVATFTLIEQDGSAYVPGDRAAPLGYPDFSGQLEIEVQTETTKTGDKLKVTTFEMILGPETNEDQAPYQGRVFASISAAASLDLVDGRVRAVPRSIYGFQDVIPEYNDGLLVPLAPPIGPFLPGEVLLRFRTYMRQVDTQDAAAEAIDCALPQEFVSWFASNAFTVQSEALLLRYRNTLTGQLLFECKLYSEGYIALSYSGPGPLTFPSNGFFEVVSWVPRLYQLASVGSLATGRTLKQ

SEQ ID NO: 1634 - protein, 540 aa, Artificial Sequence
  capsid_protein__Norovirus__ACF41177
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICSFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAS

SEQ ID NO: 1635 - protein, 540 aa, Artificial Sequence
  capsid_protein__Norovirus__ACF41180
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTKRDGSTRGHKATVSTGSVHFTPKLGSVQFSTDTSNDFEIGQNTRFTPVGVVQDGSTTHQNEPQQWVLPNYSGRDGHNVHLAPAVAPTFPGEQLLFFRSTMPGCSGYPNMNLDCLLPQEWVQHFYQESAPAQSDVALLRFVNPDTGRALFECKLHKSGYVTVAHTGQHDLVIPPNGYFRFDSWVNQFYTLAPMGNGAGRRRAL

SEQ ID NO: 1636 - protein, 540 aa, Artificial Sequence
  capsid_protein__Norovirus__ACF41181
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLPQTTKGDGSTRGHKATVSTGSVDFTPKLGSVQFATDTDNDFETGQNTRFTPVGVIQDGSSTHRNEPQQWVLPDYSGRTVYNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1637 - protein, 540 aa, Artificial Sequence
  capsid_protein__Norovirus__ACF41182
MKMASNDASPSDGSTANLVPEVNNEVMALEPVVGAAIAAPVTGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTAHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1638 - protein, 540 aa, Artificial Sequence
  capsid_protein__Norovirus__ACF41183
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRAYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1639 - protein, 540 aa, Artificial Sequence
  capsid_protein__Norovirus__ACF41184
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILAVEEMTNSRFPIPLEKLFTGPSSALVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1640 - protein, 540 aa, Artificial Sequence
  capsid_protein__Norovirus__ACF41185
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFRTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1641 - protein, 540 aa, Artificial Sequence
  capsid_protein__Norovirus__ACF41186
MKMASNDANPSGGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1642 - protein, 540 aa, Artificial Sequence
  capsid_protein__Norovirus__ACF41187
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIRGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1643 - protein, 540 aa, Artificial Sequence
  capsid_protein__Norovirus__ACF41188
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATAYTGSAPFTPKLGSVQFSTDTENDFETHQNTKFAPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1644 - protein, 540 aa, Artificial Sequence; identical to SEQ ID NO: 621
  capsid_protein__Norovirus__ACF41190

SEQ ID NO: 1645 - protein, 540 aa, Artificial Sequence
  capsid_protein__Norovirus__ACF41191
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPGFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1646 - protein, 548 aa, Artificial Sequence
  capsid_protein__Norovirus__ACF60293
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIENLSAAQITMCPHVIVDVRQLEPVNLPMPDVRNNFFHYNQGSDSKLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCRVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1647 - protein, 548 aa, Artificial Sequence
  capsid_protein__Norovirus__ACF60294
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1648 - protein, 548 aa, Artificial Sequence
  capsid_protein__Norovirus__ACF60295
MKMASNDATPSNDGAAGLVPEINNEAMALDPVAGAAIAAPLTGQQNIIDPWIMNNFVQAPGGEFTVSPRNSPGEVPLNLELGPEINPYLAHLARMYNGYAGGFEVQVVLAGNAFTAGKIIFAAIPPNFPTDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1649 - protein, 548 aa, Artificial Sequence
  capsid_protein__Norovirus__ACF60296
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1650 - protein, 548 aa, Artificial Sequence
  capsid_protein__Norovirus__ACF60297
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLYTSPTENIVVQCQNGRVTLDGELVGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1651 - protein, 541 aa, Artificial Sequence
  capsid_protein__Norovirus__ACF72688
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFSKGSLTTAQITCFPHVMCDVRTLEPIQLPLLDVRRVLWHATQDQEESMRLVCMLYTPLRTNSPGDESFVVSGRLLSKPAPDFNFVYLTPPIERTIYRMVDLPLLQPRLCTHARWPAPVYGLLVDPSLPSNPQWQNGRVHVDGTLLGTTPVSGSWVSCFAAEAAYEFQSGIGEVVTFTMIEQDGSAYVPGDRAAPLGYPDFSGQLEIEVQTETTKTGDKLKVTTFEMILGPTTNVDQAPYQGRAYASLTAMASLDLVDGRVRAVPRSIYSFQDELPEYNDGLLVPLAPPLGPFLPGEVLLRFRTYMRQLDTADAAAQPIDCALPQEFISWFASNNFTVQSDALLVRYRNTLTGQLLFEAKLYSEGYIAVSYSGSGPLTFPTDGFFEVVSWVPRLFQLASVGSLATGRTLKQ

SEQ ID NO: 1652 - protein, 540 aa, Artificial Sequence
  capsid_protein__Norovirus__ACH42093
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTKFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1653 - protein, 540 aa, Artificial Sequence; identical to SEQ ID NO: 487
  capsid_protein__Norovirus__ACH42094

SEQ ID NO: 1654 - protein, 540 aa, Artificial Sequence; identical to SEQ ID NO: 487
  capsid_protein__Norovirus__ACH42096

SEQ ID NO: 1655 - protein, 540 aa, Artificial Sequence; identical to SEQ ID NO: 487
  capsid_protein__Norovirus__ACH42097

SEQ ID NO: 1656 - protein, 540 aa, Artificial Sequence; identical to SEQ ID NO: 487
  capsid_protein__Norovirus__ACH42098

SEQ ID NO: 1657 - protein, 540 aa, Artificial Sequence
  capsid_protein__Norovirus__ACJ66263
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1658 - protein, 540 aa, Artificial Sequence
  capsid_protein__Norovirus__ACJ66265
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMSPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1659 - protein, 540 aa, Artificial Sequence
  capsid_protein__Norovirus__ACJ66267
MKMASNDANPSDGSTANLVPEVNSEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPSYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1660 - protein, 540 aa, Artificial Sequence
  capsid_protein__Norovirus__ACJ66269
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPANICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1661 - protein, 540 aa, Artificial Sequence
  capsid_protein__Norovirus__ACJ66271
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSSVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1662 - protein, 540 aa, Artificial Sequence
  capsid_protein__Norovirus__ACJ66273
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPSYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1663 - protein, 540 aa, Artificial Sequence
  capsid_protein__Norovirus__ACJ66275
MKMASSDASPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRGDGSTRGHKATVYTGSADFAPKLGRVQFATDTDNDFESNQNTKFTPVGVIQDGNTTHRNEPQQWVLPGYSGRDGHNVHLAPAVAPTYPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGAGRRRAL

SEQ ID NO: 1664 - protein, 540 aa, Artificial Sequence
  capsid_protein__Norovirus__ACJ66279
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPNFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1665 - protein, 540 aa, Artificial Sequence
  capsid_protein__Norovirus__ACJ66281
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEKMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1666 - protein, 540 aa, Artificial Sequence
  capsid_protein__Norovirus__ACJ66283
MKMASNDANPSDGSAANLVLEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1667 - protein, 540 aa, Artificial Sequence
  capsid_protein__Norovirus__ACJ66285
MKMASSDANPSDGSTANLVPEVNNEVMALEPVVGAAIAAPVAGQQNVIDPRIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCWVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRSDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1668 - protein, 540 aa, Artificial Sequence; identical to SEQ ID NO: 472
  capsid_protein__Norovirus__ACJ66286

SEQ ID NO: 1669 - protein, 541 aa, Artificial Sequence
  capsid_protein__Norovirus__ACJ72216
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPISGSWVSCFAAEAAYEFQSGTGEVVTFSMIEQDGSAYVPGDRAAPLGYPDYSGQLEIEVQTETTKAGDKLKVTTFEMILGPTTNVDQAPYQGKAYASLSTTASLDLVDGRVRAVPRSVYSFQDVLPEYNDGLLVPLAPPLGPYLPGEVLLRFRTYMRQLDTADAAAQPIDCALPQEFISWFASSNFTVQSEALLVRYRNTLTGQLLFEAKLYSEGYIAVSYSGSGPLTFPTDGFFEVVSWVPRLFQLASVGSLATGRTLKQ

SEQ ID NO: 1670 - protein, 539 aa, Artificial Sequence
  capsid_protein__Norovirus__ACL27297
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGADVFTVSRRVLTRPSPDFDFIFSVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1671 - protein, 540 aa, Artificial Sequence
  capsid_protein__Norovirus__ACL27298
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDFETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1672 - protein, 540 aa, Artificial Sequence
  capsid_protein__Norovirus__ACL27299
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTRRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1673 - protein, 540 aa, Artificial Sequence
  capsid_protein__Norovirus__ACL27300
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTRRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 1674 - protein, 540 aa, Artificial Sequence
  capsid_protein__Norovirus__ACL31312
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1675 - protein, 540 aa, Artificial Sequence
  capsid_protein__Norovirus__ACL31313
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPAYSGRDNHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1676 - protein, 540 aa, Artificial Sequence
  capsid_protein__Norovirus__ACL31316
MKMASSDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGMPTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1677 - protein, 540 aa, Artificial Sequence
  capsid_protein__Norovirus__ACL31317
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1678 - protein, 540 aa, Artificial Sequence
  capsid_protein__Norovirus__ACL31319
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1679 - protein, 540 aa, Artificial Sequence
  capsid_protein__Norovirus__ACL31320
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVNFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1680 - protein, 540 aa, Artificial Sequence
  capsid_protein__Norovirus__ACL31322
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWALPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1681 - protein, 540 aa, Artificial Sequence
  capsid_protein__Norovirus__ACL31324
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1682 - protein, 535 aa, Artificial Sequence
  capsid_protein__Norovirus__ACL31325
MKMASNDAAPSNDGAAGLVPEVNNETMALEPVVGASIAAPLTGQNNVIDPWIRLNFVQAPNGEFTVSPRNSPGEVLLNLELGPELNPYLAHLSRMYNGYAGGVEVQVLLAGTAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHANACRSHDAVIATNSAKFTPKLGAIQIGTWEQDDVHINQPTKFTPVGLFENEGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 1683 - protein, 542 aa, Artificial Sequence
  capsid_protein__Norovirus__ACL31326
MKMASNDAAPSNDGAASLVPEGVNETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNETNVVQCQNGRCTLDGELQGTTQLLSSAVCSYRGRTVANSGDNWDQNLLQLTYPNGASYDPTDEVPAPLGTQDFSGMLYGVLTQDNVNVSTGEAKNAKGIYISTTSGKFTPKIGSIGLHSITEHVHPNQQSRFTPVGVAVNENTPFQQWVLPHYAGSLALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRVQ

SEQ ID NO: 1684 - protein, 540 aa, Artificial Sequence
  capsid_protein__Norovirus__ACL31340
MKMASNDATPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTNIAGSQTYTMNLASQNWNNYDPTEEIPAPLGTPDFVGKIQGVLTQTTKGDGSTRGHKATVSTGSAQFTPKLGSVQFSTDTSTDFETGQNTRFTPVGVIQDGSTTHKNEPQQWVLPSYSGRDSHNVHLAPAVAPTFPGEQILFFRSTMPGCSGYPNMDLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1685 - protein, 540 aa, Artificial Sequence
  capsid_protein__Norovirus__ACL31354
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1686 - protein, 540 aa, Artificial Sequence
  capsid_protein__Norovirus__ACL31355
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1687 - protein, 540 aa, Artificial Sequence; identical to SEQ ID NO: 462
  capsid_protein__Norovirus__ACL31356

SEQ ID NO: 1688 - protein, 540 aa, Artificial Sequence
  capsid_protein__Norovirus__ACL31358
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVIHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1689 - protein, 548 aa, Artificial Sequence
  capsid_protein__Norovirus__ACL31361
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKIDTTSGRFTPKLGSLEISTESDDFDQNKPTRFTPVGIGVDHEADFQQWALPDYAGQFTHNMNLAPAVAPNFPGEQLLFFRSQLPSSGGRSNGILDCLVPQEWVQHFYQESAPSQSQVALVRYINPDTGRVLFEAKLHKLGFITIAKNGDSPITVPPNGYFRFESWVNPFYTLAPMGTGNGRRRIQ

SEQ ID NO: 1690 - protein, 540 aa, Artificial Sequence
  capsid_protein__Norovirus__ACL31365
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGSNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1691 - protein, 540 aa, Artificial Sequence
  capsid_protein__Norovirus__ACL36375
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1692 - protein, 530 aa, Artificial Sequence; identical to SEQ ID NO: 1605
  capsid_protein__Norovirus__ACN32270

SEQ ID NO: 1693 - protein, 535 aa, Artificial Sequence
  capsid_protein__Norovirus__ACT52403
MKMASNDASPSSDGSANLVPEINNEVMALEPVAGAAIAAPVAGQQNIIDPWIRNNFVQAPGGEFTVSPRSAPGEVLLNLPLSPDINPYLAHLSRMYNGYAGGVEVEVVLAGNAFTAGKIIFAAVPPNFPPENLSPSQITMLPHIIVDVRQLEPVRIPLPDVRNNFYHYSRENDSTLRLIAMLYTPLRANNAGDDVFTVSCRVLTRPSPDFDFIFLVPPTVESKSKPFTIPILTIEEMTNSRFPAPLEMMTTGPSHDIVVQPQNGRCTIDGVLLGTTQLSPVNICSMRGVPTKRTNGTDNCFVQLENPNGSAYDPTEDIPAVLGSPDFVGEFYGTITQRSPNNSTRAHPFTLNTGSPRYTPKIGSVDIHVTDVEDLNDHEPVKLTPVGLSGSSGSIHQWQLPNYSGVATHNMHLAPSVAPLFPGEQILFFRSTVPGCGGYPNTNIDCLIPQEWVQHFYQEGAPARTDVALLRFINPDTGRVLFECKLHKHGFITVAYSGNHDLVMPPNGYFRFESWVNQFHTLAPMGTGSGRRRIQ

SEQ ID NO: 1694 - protein, 548 aa, Artificial Sequence
  capsid_protein__Norovirus__ACT52405
MKMASNDATPSNDGAAGLVPEINNEAMALDPVAGAAIAAPLTGQQNIIDPWIMDNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESNDFDQNQPTRFTPVGIGVDHEADFQQWSLPDYSGQFTHNMNLVPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRNQ

SEQ ID NO: 1695 - protein, 548 aa, Artificial Sequence
  capsid_protein__Norovirus__ACT52407
MKMASNDATPSNDGAAGLVPEINNEAMALDPVAGAAIAAPLTGQQNIIDPWIMNNFVQAPGGEFTVSPRNSPGEVLLNLELGPEINPYLSHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRNQ

SEQ ID NO: 1696 - protein, 535 aa, Artificial Sequence
  capsid_protein__Norovirus__ACT52409
MKMASNDAAPSNDGAAGLVPEVNNETMALEPVAGASIAAPLTGQNNVIDPWIRMNFVQAPNGEFTVSPRNSPGEILLNLELGPELNPFLAHLSRMYNGYAGGVEVQVLLAGNAFTAGKLVFAAIPPHFPIENLSPGQITMFPHVIIDVRTLEPVLLPLPDVRNSFFHYNQEPEPRMRLVAMLYTPLRSNGSGDDVFTVSCRVLTRPSPDFDFNYLVPPTVESKTKPFTLPILTIGELSNSRFPAPIDELYTSPNEGLVVQPQNGRSTLDGELLGTTQLVPSNICSLRGRTNAHLPDNQHRWNMQVTNPNGTPFDPTEDVPAPLGTPDFLANIYGVTSQRNPNNTCRAHDGILATWSPKFTPKLGSVVLGTWEDRDFDINQPTRFTPVGLYDTDHFNQWALPNYSGALTLNMNLAPSVAPLFPGEQLLFFRSHIPLKGGTSNGAIDCLLPQEWVQHFYQESAPSSTDVALIRYTNPDTGRVLFEAKLHRQGFITVSNSGSRPIVVPPNGYFRFDSWVNQFYSLAPMGTGNGRRRVQ

SEQ ID NO: 1697 - protein, 540 aa, Artificial Sequence
  capsid_protein__Norovirus__ACT78459
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDHDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1698 - protein, 546 aa, Artificial Sequence
  capsid_protein__Norovirus__ACU56258
MMMASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVDVQTDVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYVTHFVSEQAPTMGDAALLHYVDPDTNRNLGEFKLYPGGYLTCVPNGVGAGPQQLPLNGVFLFVSWVSRFYQLKPVGTASTARGRLGVRRI

SEQ ID NO: 1699 - protein, 545 aa, Artificial Sequence
  capsid_protein__Norovirus__ACX33982
MMMASKDAPTNMDGTSGAGQLVPEANTAEPISMEPVAGAATAAATAGQVNMIDPWIMNNYVQAPQGEFTISPNNTPGDVLFDLQLGPHLNPFLSHLAQMYNGWVGNMKVKVLLAGNAFTAGKIIISCIPPGFAAQNFSIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMISRDHGQMVQFQNGRVTLDGQLQGTTPTSASQLCKIRGSVFHANGGNGYNLTELDGSPYHAFESPAPIGFPDLGECDWHMEASPITQFDTGDVIKQINVKQESAFAPHLGTVQADGLSDVSANTNMIAKLGWVSPVSDGHRSDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRLGIRRS

SEQ ID NO: 1700 - protein, 545 aa, Artificial Sequence
  capsid_protein__Norovirus__ACX33983
MMMASKDAPTNMDGTSGAGQLVPEANTAEPISMEPVAGAATAAATAGQVNMIDPWIMNNYVQAPQGEFTISPNNTPGDVLFDLQLGPHLNPFLSHLAQMYNGWVGNMKVKVLLAGNAFTAGKIIISCIPPGFVAQNFSIAQATMFPHVIADVRVLEPIEVPLEDVRNVLFHNNDNTPTMRLVCMLYTPLRAGGSSSGTDPFVIAGRVLTCPSPDFSFLFLVPPNVEQKTKPFSVPNLPLNTLSNSRVPSLIKSMMISRDHGQMVQFQNGRVTLDGQLQGTTPTSASQLCKIRGSVFHANGGNGYNLTELDGSPYHAFESPAPIGFPDLGECDWHMEASPTTQFDTGDVIKQINVKQESAFAPHLGTVQADGLSDVSANTNMIAKLGWVSPVSDGHRSDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRLGIRRS

SEQ ID NO: 1701 - protein, 536 aa, Artificial Sequence
  capsid_protein__Norovirus__ACX81341
MKMASNDATPSDDGAAGLVPEINNEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAMLYGVASQRSSIDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 1702 - protein, 536 aa, Artificial Sequence; identical to SEQ ID NO: 1701
  capsid_protein__Norovirus__ACX81343

SEQ ID NO: 1703 - protein, 536 aa, Artificial Sequence
  capsid_protein__Norovirus__ACX81345
MKMASNDATPSDDGAAGLVPEINSEVMALEPVAGASLAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMSPHVIVDVRQLKPVLLPMPDIKNDFNHYNQKNNTKLRLVAMLYTPLRANNSGDDVCTESCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAMLYGVASQRSSIDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 1704 - protein, 536 aa, Artificial Sequence; identical to SEQ ID NO: 1701
  capsid_protein__Norovirus__ACX81347

SEQ ID NO: 1705 - protein, 536 aa, Artificial Sequence; identical to SEQ ID NO: 1701
  capsid_protein__Norovirus__ACX81349

SEQ ID NO: 1706 - protein, 536 aa, Artificial Sequence; identical to SEQ ID NO: 1701
  capsid_protein__Norovirus__ACX81351

SEQ ID NO: 1707 - protein, 536 aa, Artificial Sequence
  capsid_protein__Norovirus__ACX81353
MKMASNDATPSDDGAAGLVPEINNEVMALEPVAGASIAAPVVGQQNIIDPWIRNNFVQAPAGEFTVSPRNSPGELLLDLELGPELNPYLAHLARMYNGHAGGMEVQIVLAGNAFTAGKILFAAIPPSFPYENLSPAQLTMCPHVIVDVRQLEPVLLPMPDIRNVFYHYNQNNSPKLRLVAMLYTPLRANNSGDDVFTVSCRVLTRPSPDFQFTFLVPPTVESKTKNFTLPVLRVSEMTNSRFPVVLDQMYTSRNENIIVQPQNGRCTTDGELLGTTILQSVSICNFKGTMQAKLNEEPRYQLQLTNLDGSPIDPTDDMPAPLGTPDFQAMLYGVASQRSSRDNATRAHDAQIDTAGDTFAPKIGQVRFKSSSNDFDLHDPTKFTPIGVNVDDQHPFRQWSLPNYGGHLALNNHLAPAVTPLFPGEQILFFRSYIPSAGGHTDGAMDCLLPQEWVEHFYQEAAPSQSDIALVRFINPDTGRVLFEAKLHKQGFLTIAASGDHPIVMPTNGYFRFEAWVNPFYTLAPVGTGSGRRRIQ

SEQ ID NO: 1708 - protein, 536 aa, Artificial Sequence; identical to SEQ ID NO: 1701
  capsid_protein__Norovirus__ACX81355

SEQ ID NO: 1709 - protein, 540 aa, Artificial Sequence
  capsid_protein__Norovirus__ACX85806
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1710 - protein, 548 aa, Artificial Sequence
  capsid_protein__Norovirus__ACX85807
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNALTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDATTRAHEAKIDTTSGRFTPKLGSLEISTESDDFDQNKPTRFTPVGIGVDHEEDFQQWTLPDYAGQFTHNMNLAPAVAPNFPGEQLLFFRSQLPSSGGRSNGILDCLVPQEWVQHFYQESAPSQTQVALVRYINPDTGRVLFEAKLHKLGFMTIAKNGDSPITVPPNGYFRFESWVNPFYTLAPMGTGNGRRRIQ

SEQ ID NO: 1711 - protein, 540 aa, Artificial Sequence
  capsid_protein__Norovirus__ACX85809
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLIAMLYTPLRANNSGDDVFTVSWRGLTKTSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEANINTGGDQYAPKLAQVKFFSESQDFEVHQPTVFTPVGVAGDTSHPFRQWVLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRIQ

SEQ ID NO: 1712 - protein, 540 aa, Artificial Sequence
  capsid_protein__Norovirus__ACX85810
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLIAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEANINTGGDQYAPKLAQVKFFSESQDFEVHQPTVFTPVGVAGDTSHPFRQWVLPRYGGHLTNNTHLAPAVAPLFPGEQILFFRSQIPSSGGHELGYMDCLVPQEWVQHFYQEAAAAQSEVALIRFINPDTGRVLFEAKLHKQGFITVAHTGDNPIVMPPNGYFRFEAWVNQFYSLAPVGTGNGRRRIQ

SEQ ID NO: 1713 - protein, 522 aa, Artificial Sequence
  capsid_protein__Norovirus__ACY41155
MKMTDRDTTDPAPALGQVLPPEVEASVPVEPTAGAPVAAATAGQVNPIDPWIFANFVQAPQGEFTISPNNNPGEILFELELGPELNPYLAHLRRMYNGWTGSMRVRVLLAGNAFSAGKVVVFCVPPGFDASYLTPSQATQFPHVLIDVRAPEPVEMPLEDVRNILFHQGPDSRMRLMGMLYTPLRANSGADPFVVTGRVLTCPSPNFSFFFLVPPTVEEREVPFTLPNLPVNNLSHSRVMEPIAQMMSSRNLPASVQFQNGRCTLAGDLLGTTPSSPADLGTFVGLIAEPGSRVVELFQPNQEDFHAGSAPAPLGFPDFSDCSLTFVVASSTTVGERTVNSRSPQNFTPALGHVTLDEEAPADLFRARLRNLWDPTEHSFWRIPDYRADVLGSEFAPSVSAPGVGETLLFFMCNVPRLNGANPNPCPCLLPQEWITHFVSERAALQGDVALLNYVNPNTGRVLFECKLYANGFLTVNLGASDQATLPVDGIFKFVSWVSFYYQLRPVGNASVGRRLPRLNGF

SEQ ID NO: 1714 - protein, 540 aa, Artificial Sequence; identical to SEQ ID NO: 1048
  capsid_protein__Norovirus__ADA77528

SEQ ID NO: 1715 - protein, 539 aa, Artificial Sequence
  capsid_protein__Norovirus__ADB22512
MKMASNDAAPSNDGATGLVPEVNTETLPLEPVAGAAIAAPVTGQNNIIDPWIRSNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGMTSNPTSDYWDGHLLHLVHPNGATYDPTEDVPAPFGTQDFRGILYGMLTQNPRTSGDEAANSHGVYISSTSEKFTPKLGTIGLHQVQGDHSQQQQSKFTPVGIAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRIQ

SEQ ID NO: 1716 - protein, 540 aa, Artificial Sequence
  capsid_protein__Norovirus__ADC91993
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1717 - protein, 540 aa, Artificial Sequence
  capsid_protein__Norovirus__ADC91994
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1718 - protein, 536 aa, Artificial Sequence; identical to SEQ ID NO: 1701
  capsid_protein__Norovirus__ADE28701

SEQ ID NO: 1719 - protein, 547 aa, Artificial Sequence
  capsid_protein__Norovirus__ADE28721
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYPDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMSLAPAVAPAFPGERILFFRSIVPSAGGYGSGYIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1720 - protein, 547 aa, Artificial Sequence
  capsid_protein__Norovirus__ADE28722
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMFYTDPNEGIVVHPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSGYIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1721 - protein, 547 aa, Artificial Sequence
  capsid_protein__Norovirus__ADE28723
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQISRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSGYIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1722 - protein, 547 aa, Artificial Sequence
  capsid_protein__Norovirus__ADE28724
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSDYIDCLIPQEWVQHFYQEAAPSQSAVALIRYVNPDTGRNIFEAKLHREGFITVANSGNNPIVVPPNGYFRFEAWVNQFYTLAPMGTGQGRRRNQ

SEQ ID NO: 1723 - protein, 548 aa, Artificial Sequence
  capsid_protein__Norovirus__ADK23787
MKMASNDATPSNDGAAGLVPEISNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENVVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKIDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1724 - protein, 540 aa, Artificial Sequence
  capsid_protein__Norovirus__ADM52743
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1725 - protein, 540 aa, Artificial Sequence
  capsid_protein__Norovirus__ADR57234
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRADGSTRGHRATVYTGSAEFAPKLGRVQFATDTENDFDTNQNTKFTPVGVIQDGNTTHRNEPQQWVLPSYSGRNSHNVHLAPAVAPTFPGEQLLFFRSTMPGCSGYPNLDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1726 - protein, 541 aa, Artificial Sequence
  capsid_protein__Norovirus__AEA07712
MRMSDGAAPKASGSEASGQDLVPSAVEQAVPIQPVVGATLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSITTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGIGEVATFTLIEQDGSAYLPGDRAAPLGYPDFSGQLEIEVQTETTKAGDKLKVTTFEMALGPTTNVDQAPYQGRVFASFTASASLDLVDGRVRAVPRSIFGFQDVVPEYNDGLLVPLAPPIGPFLPGEVLLRFRTYMRQIDSSDAAAEAIDCALPQEFVSWFASNGFTVQSDALLLRYRNTLTGQLLFECKLYSDGYIALSYSGSGPLTFPTDGFFEVVSWVPRLYQLASVGSLATGRTLKQ

SEQ ID NO: 1727 - protein, 540 aa, Artificial Sequence
  capsid_protein__Norovirus__AEK05311
MKMASNDANPSDGSAANLVPEVNNEVMALEPVVGAAIAAPVAGQQNVIDPWIRNNFVQAPGGEFAVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFAPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1728 - protein, 535 aa, Artificial Sequence
  capsid_protein__Norovirus__AEP16505
MKMASSDAAPSNDGAAGLVPEVNNETMALEPVAGASIAAPLTGQNNVIDPWIRMNFVQAPNGEFTVSPRNSPGEVLLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVVVQPQNGRSTLDGELLGTTQLVPSNICALRGRINAQVPDDHHQWNLQVTNANGTSFDPTEDVPAPLGTPDFLANIYGVTSQRNPDNTCRAHDGVLATWSPKFTPKLGSVVLGTWEESDLDLNQPTRFTPVGLYDTNHFDQWILPNYSGRLTLNMNLAPSVAPLFPGEQILFFRSHIPLKGGTSNGAIDCLLPQEWIQHFYQESAPSPTDVALIRYPNPDTGRVLFEAKLLRPGFITVANFGFKPIVVPPKGYFRFDSWVNQFYSLAPMGTGNGRRRVQ

SEQ ID NO: 1729 - protein, 543 aa, Artificial Sequence
  capsid_protein__Norovirus__AEY77318
MMMASKDAPTNMDGTSGAGQLVPEVSTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIKSMMVSQDHGQMVQFQNGRVTLDGQLQGTTPTSASQLCKIRGTVYHATGGQGLNLTEIDGTPYHAFESPAPIGFPDLGECDWHINASPANAFTDGSIIHRIDVAQDSTFAPHLGTIHYTNADYNANVGLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRLGIRRS

SEQ ID NO: 1730 - protein, 541 aa, Artificial Sequence
  capsid_protein__Norovirus__AEY83583
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAPDFNFVYLTPPIERTIYRMVDLPVLQPRLCTHARWPAPVYGLLVDPSLPSNPQWQNGRVQVDGTLLGTTPVSGSWVSCFAAEAAYEFQAGTGEVVTFTMIEQDGSAYVPGDRAAPLGYPDFSGQLEIEVQTETTKTGDKLRVTTFEMILGPTTNVDQAPYQGRAYASLTAAASLDLVDGRVRAVPRSIYSFQDELPEYNDGVLVPLAPPLGPFLPGEVLLRFRTYMRQLDTADAAAQPIDCALPQEFISWFASNNFTVQSDALLVRYRNTLTGQLLFEAKLYSEGYIAVSYSGSGPLTFPTDGFFEVVSWVPRLFQLASVGSLVTGRTLKQ

SEQ ID NO: 1731 - protein, 542 aa, Artificial Sequence
  capsid_protein__Norovirus__AFB18010
MKMASNDAAPSTDGAAGLVPESNNEVMALEPVAGAALAAPVTGQTNIIDPWIRTNFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVEFKTKPFTLPILTLGEMSNSRFPVPIDQMYTSPNEIISVQCQNGRCTLDGELQGTTQLQVSGICAFKGQVTAHLQDNEHLYNVTITNLNGSPFDPSEDIPAPLGVPDFEGRVFGVISQRDNYNSGGQNQPANRSHDAVVPTYTAQYTPKLGQIQIGTWQTDDITVDQPAKFTPVGLSDTDHSNQWVVPRYAGALNLNTNLAPSVAPVFPGERLLFFRSYIPLKGGFGNPAIDCLVPQEWIQHFYQEAAPSLSEVALARYINPDTGRALFEAKLHRAGFMTVSSNTSAPVVVPANGYFRFDSWVNQFYSLAPMGTGNGRRRIQ

SEQ ID NO: 1732 - protein, 540 aa, Artificial Sequence
  capsid_protein__Norovirus__AFB18013
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1733 - protein, 580 aa, Artificial Sequence
  capsid_protein__Norovirus__AFJ05624
MKMASNDATAPSQDGAANLVPESQHEVLALEPVAGAALAAPVAGQFNAIDPWIKQNFVQAPAGEFTVSPRNAPGEILMDLELGPELNPFLAHLAQMYNAYAGGMEVQIILAGNAFTAGKIIVCAVPPNFPPDRLSASQATNFPHVIMDVRTLEPVILPLPDVRAGFFHYNQLREPRMRLMALLYTPLRANGTGDDAFTVSCRVLTRPMQDFEFMFLVPPTVESRVTPFSVPTYPVVEMTNSRWPARISGMHVNANQTLAVQFQNGRCTLDGQLMGTTQLCAADVCRMRGRYTSTRADLAGVDHTDQGPSLGTGPSDDSVSVPEARAQTRTGVSAHLQLEELNGQPYEVYGEQPAPLGTPDFRCRLMGELVRLPSTSPAAQSRFRDAFFDTYGALFAPAVGSTTFTVNNSSTSDFANGQPFEFLPIGVEIGNSAQYDEFALPSYNGAIGENRHLAPVAAPGFPGENIVFFSSNLPVWDSTSAQNNRRISCLLPNEFVQHFYDLQAPSQSDVALLRYVHPESGRVLFECKLYRDGFLTVNGASLAEFPVNGYFRFDSWVNQFFTLSPVGTGSGRRGRSRNAQ

SEQ ID NO: 1734 - protein, 581 aa, Artificial Sequence
  capsid_protein__Norovirus__AFJ05628
MKMASNDAASPSSDGAANLVPEINNEVMALEPVAGAQLAAPVAGQFNAIDPWIRQNFVQAPEGEFTVSPRNAPGEILLNLELGPHLNPFLQHLAQMYNAYAGGMEVQVVLAGNAFTAGKIIFAAVPPHFPPERLSAAQATQFPHVIVDVRQLEPIILPLPDVRHNLFHFNQQNDERMHLVAFLYTPLRANSGSGDDVFTVSCRVLTRPSQDFEFMFLVPPTVEKKTVAFSLPQLAIGEMSNSRWPARITGLVVDPRLPQVLHIQNGRCTLDGTLMGTTQLNPNDICRIRGYFSSSRPELLCENEESATDPMPTETDTDNQPPEVRAQARATQRWFAVTELNGQVYDPFGDQPAPLGVPDFKARILGALMRLPGTNPTSNSRFEDAWVETNNQTTYAPAAGVVAITTNDNSSSNYANDQTCEFVPLGIEITDSAPYHEFDLPSYGGAASSGNRNLAPTVAPTFPGEAILLFGSNMPVYNRNTGTSNKDIRCLLPNEYVQHLYDTQAPSLSDVALVRYVNRDTGRVLFEAKLHRDGFMTVNASSTTVLPVDGYFRFDSWVNQFYALSPVGNASGRRGRSRQTN

SEQ ID NO: 1735 - protein, 540 aa, Artificial Sequence
  capsid_protein__Norovirus__AFJ24945
MKMASNDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1736 - protein, 545 aa, Artificial Sequence
  capsid_protein__Norovirus__AFK75851
MMMASKDAPPNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIRSMMVSRDHGQMVQFQNGRVTLDGQLQGTTPTSASQLCKIRGSVFHANGGNGYNLTELDGSPYHAFESPAPIGFPDLGECDWHMEASPTTQFDTGDVIKQINVKQEAAFAPHLGTIQADGLSDVSVNTNMIAKLGWVSPVSDGHRGSVDPWVIPRYGSTLTEAAQLAPPIYPPGFGEAIVFFMSDFPIAHGANGLSVPCTIPQEFVTHFVNEQAPTRGEAALLHYLDPDTHRNLGEFKLYPEGFMTCVPNSSGTGPQTLPINGVFAFVSWVSRFYQLKPVGTAGPARRLGIRRS

SEQ ID NO: 1737 - protein, 544 aa, Artificial Sequence
  capsid_protein__Norovirus__AFK75852
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEMSKIPNSSTQSNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 1738 - protein, 546 aa, Artificial Sequence
  capsid_protein__Norovirus__AFK75853
MMMASKDASQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTARGRLGVRRI

SEQ ID NO: 1739 - protein, 548 aa, Artificial Sequence
  capsid_protein__Norovirus__AFK75854
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNTFFHYNQDSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNHRWHIQLDNLNGTPYDPAEDIPAPLGTPDFRGKVFGVASQRNPDSTTRAHEAKVDTTSGRFTPKLGSLEITTESDDFDTNQSTKFTPVGIGVDNEAEFQQWSLPNYSGQFTHNMNLAPAVAPNFPGEQLLFFRSQLPSSGGWSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1740 - protein, 556 aa, Artificial Sequence
  capsid_protein__Norovirus__AFN61315
MKMASSDAAPSADGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWIRLQEPDGQPYDIFGKQPAPIGTPDFKAVIVGFAARPLTSGSYANEAYVNTTASDYAPATGNMRFTVRNGGTGHISANKYWEFRSFGVEGERHTDVQYQEYELPDYSGQVASNHNLAPPVAPRMPGESLLLFQSNMPVWDDGRGESTPKKIHCLLPQEFIGHFFDKQAPSLGDAALLRYVNQETNRVLFECKLYRDGYITVAAASGLLDFPLDGFFRFDSWVSSFYILSPVGSGQGRRGRVRFQ

SEQ ID NO: 1741 - protein, 540 aa, Artificial Sequence
  capsid_protein__Norovirus__AFQ00511
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 1742 - protein, 540 aa, Artificial Sequence; identical to SEQ ID NO: 621
  capsid_protein__Norovirus__AFQ00512

SEQ ID NO: 1743 - protein, 540 aa, Artificial Sequence
  capsid_protein__Norovirus__AFQ00513
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1744 - protein, 540 aa, Artificial Sequence
  capsid_protein__Norovirus__AFQ00516
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1745 - protein, 540 aa, Artificial Sequence; identical to SEQ ID NO: 621
  capsid_protein__Norovirus__AFQ00517

SEQ ID NO: 1746 - protein, 540 aa, Artificial Sequence; identical to SEQ ID NO: 1286
  capsid_protein__Norovirus__AFQ00518

SEQ ID NO: 1747 - protein, 540 aa, Artificial Sequence
  capsid_protein__Norovirus__AFQ00519
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTRGDGSTRGHKATVYTGSAPFTPKMGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1748 - protein, 540 aa, Artificial Sequence
  capsid_protein__Norovirus__AFQ00520
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 1749 - protein, 540 aa, Artificial Sequence
  capsid_protein__Norovirus__AFQ00521
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 1750 - protein, 540 aa, Artificial Sequence
  capsid_protein__Norovirus__AFQ00522
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 1751 - protein, 540 aa, Artificial Sequence; identical to SEQ ID NO: 1750
  capsid_protein__Norovirus__AFQ00523

SEQ ID NO: 1752 - protein, 540 aa, Artificial Sequence; identical to SEQ ID NO: 1286
  capsid_protein__Norovirus__AFQ00524

SEQ ID NO: 1753 - protein, 540 aa, Artificial Sequence; identical to SEQ ID NO: 1286
  capsid_protein__Norovirus__AFQ00525

SEQ ID NO: 1754 - protein, 540 aa, Artificial Sequence
  capsid_protein__Norovirus__AFQ00526
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYAMNLASLNWNNYDPTEEIPAPLGTPDFVGKIQGVLTQTTKGDGSTRGHKATIYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYLTVAHTGQHDLVIPPNGYFRFDSWVNQFYTLAPMGNGTGRRRAL

SEQ ID NO: 1755 - protein, 540 aa, Artificial Sequence; identical to SEQ ID NO: 1286
  capsid_protein__Norovirus__AFQ00527

SEQ ID NO: 1756 - protein, 540 aa, Artificial Sequence
  capsid_protein__Norovirus__AFQ00528
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNAHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1757 - protein, 547 aa, Artificial Sequence
  capsid_protein__Norovirus__AGC66782
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQIGRCTLDGSLQGTTQLVPTQICSFGGTLISQTSRSADSTDSAPRVRNHPLHVQLKNLDGTPYDPTDEVPAVLGAIDFKGTVFGVASQRNTTGGSVGATRAHEVHIDTTNPRYTPKLGSALMYSESDDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNILEAKLHREGFITVANSGNNPIVVPPNGYFRFEAWVNQFYTLTPMGTGQGRRRVQ

SEQ ID NO: 1758 - protein, 540 aa, Artificial Sequence
  capsid_protein__Norovirus__AGC66784
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSSDFDFIFLVPPTVESRTKPFTVPILTVEEMTNSRFPIPLEKLFTGPSSAFVVQPQNGRCTTDGVLLGTTQLSPVNTCTFRGDVTHIAGSRNYTMNLASLNWNNYDPTEEIPAPLGTPDFVGKIQGVLTQTTKGDGSTRGHKATIYTGSAPFTPKLGSVQFNTDTENDFETHQNTKFTPVGVIQDGGTTHRNEPQQWVLPSYSGRNIPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1759 - protein, 548 aa, Artificial Sequence
  capsid_protein__Norovirus__AGC66785
MKMASNDATPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGMLTRSTSRASDQADTATPRLFNYYWHIQLDNLNGTPYDPAEDIPGPLGTPDFRGKVFGVASQRNPDATTRAHEAKIDTTSGRFTPKLGSLEISTESGDFDQNQPTRFTPVGIGVDREADFQQWTLPDYAGQFTHNMNLAPAVAPNFPGEQLLFFRSQLPSSGGRSNGILDCLVPQEWVQHFYQESAPSQTQVALVRYINPDTGRVLFEAKLHKLGFMTIAKSGDSPITVPPNGYFRFESWVNPFYTLAPMGTGNGRRRIQ

SEQ ID NO: 1760 - protein, 547 aa, Artificial Sequence
  capsid_protein__Norovirus__AGC66786
MKMASNDAAPSNDGAANLVPEADNEVMALEPVVGASIAAPVVGQQNIIDPWIRENFVQAPQGEFTVSPRNSPGEMLLNLELGPGLNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQSGRCTLDGTLQGTTQLVPTQICSFRGTLISQTSRSADSTDSAPRVRNHPPHVQLKNLDGTPYDPTDEVPAVLGAIDFKGTVFGVASQRNTTGGSVGATRAHEVHIDTTNPRYTPKLGSVLMYSESDDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 1761 - protein, 540 aa, Artificial Sequence
  capsid_protein__Norovirus__AGC66788
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGGTTHRNEPQQWVLPNYSGSDVPNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1762 - protein, 542 aa, Artificial Sequence
  capsid_protein__Norovirus__AGL96587
MKMASNDAAPSNDGAASLVPEGINETMPLEPVAGASIAAPVAGQTNIIDPWIRTNFVQAPNGEFTVSPRNSPGEILLNLELGPDLNPYLAHLPRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVLTVSCRVLTRPTPDFEFIYLVPPSVESKTKPFTLPILTISELTNSRFPIPIEQLYTAPNETNVVQCQNGRCTLDGELQGTTQLLSSAVCSYRGRTVANNGDNWDQNLLQLTYPNGASYDPTDEVPAPLGTQDFSGMLYGVLTQDNVNVSTGEAKNAKGIYISTTSGKFTPKIGSIGLHSITEHVHPNQQSRFTPVGVAVNENTPFQQWVLPHYAGSTRSHTNLGTALAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRIQ

SEQ ID NO: 1763 - protein, 540 aa, Artificial Sequence
  capsid_protein__Norovirus__AGQ57036
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAHEADINTGGDQYAPKLAQVKFFSESQDFEVHQPTVFTPVGVAGDASHPFRQWVLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRIQ

SEQ ID NO: 1764 - protein, 540 aa, Artificial Sequence
  capsid_protein__Norovirus__AGT95926
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1765 - protein, 540 aa, Artificial Sequence
  capsid_protein__Norovirus__AGT95927
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEVNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1766 - protein, 540 aa, Artificial Sequence
  capsid_protein__Norovirus__AGT95928
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVSICTFRGDVTHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1767 - protein, 540 aa, Artificial Sequence
  capsid_protein__Norovirus__AGT95929
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRVV

SEQ ID NO: 1768 - protein, 540 aa, Artificial Sequence
  capsid_protein__Norovirus__AGT95930
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSTDFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1769 - protein, 540 aa, Artificial Sequence
  capsid_protein__Norovirus__AGT95931
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1770 - protein, 540 aa, Artificial Sequence
  capsid_protein__Norovirus__AHC12655
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVSTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1771 - protein, 540 aa, Artificial Sequence
  capsid_protein__Norovirus__AHC12658
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAIPPNFPTEGLSPSQVTMFPHIVVDVRQLEPVLIPLPDVRNNFYHYNQSNDPTIKLIAMLYTPLRANNAGGDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQITKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 1772 - protein, 543 aa, Artificial Sequence
  capsid_protein__Norovirus__AHW99832
MMMASKDAPSSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIICCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSKVINLTELDGSPFLAFEAPAPTGFPDLGTSDWHVEMSLNSNSQSSGNPILLRDIHPNSSEFVPHLGSVCVTAAIEVAGDYTGTIQWTSQPSNVTPVPDVNFWTIPHYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSARGRLGVRR

SEQ ID NO: 1773 - protein, 548 aa, Artificial Sequence
  capsid_protein__Norovirus__AHZ12735
MKMASNDATPSNDGAAGLVPEINNEAMALEPVAGAAIAAPLTGQQNIIDPWIMNNFVQAPGGEFTVSPRNSPGEVLLNLELGQEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRTSDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDREADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 1774 - protein, 548 aa, Artificial Sequence
  capsid_protein__Norovirus__AHZ12736
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDNTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 1775 - protein, 548 aa, Artificial Sequence
  capsid_protein__Norovirus__AHZ12737
MKMASNDAAPSNDGAAGLVPEINSEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGTLTRSTSRASDQADTATPRLFNYYWHIQLDNLNGTPYDPAEDIPGPLGTPDFRGKVFGVASQRNPDATTRAHEAKIDTTSGRFTPKLGSLEISTESDDFDQNQPTRFTPVGVGVDHEPDFQQWVLPDYAGQFTHNMNLAPAVAPNFPGEQLLFFRSQLPSSGGRSNGILDCLVPQEWVQHFYQESAPSQTQVALVRYVNPDTGRVLFEAKLHKLGFMTIAKSGDSPITVPPNGYFRFESWVNPFYTLAPMGTGNGRRRIQ

SEQ ID NO: 1776 - protein, 548 aa, Artificial Sequence
  capsid_protein__Norovirus__AHZ12738
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 1777 - protein, 548 aa, Artificial Sequence
  capsid_protein__Norovirus__AHZ12739
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRTSDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 1778 - protein, 540 aa, Artificial Sequence
  capsid_protein__Norovirus__AHZ12912
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVSICTFRGDVTHIPGSHNYTMNLASQNWNSYDPTEEIPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1779 - protein, 540 aa, Artificial Sequence; identical to SEQ ID NO: 1778
  capsid_protein__Norovirus__AHZ12913

SEQ ID NO: 1780 - protein, 540 aa, Artificial Sequence
  capsid_protein__Norovirus__AHZ12998
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1781 - protein, 540 aa, Artificial Sequence; identical to SEQ ID NO: 1780
  capsid_protein__Norovirus__AHZ13001

SEQ ID NO: 1782 - protein, 540 aa, Artificial Sequence; identical to SEQ ID NO: 1780
  capsid_protein__Norovirus__AHZ13004

SEQ ID NO: 1783 - protein, 540 aa, Artificial Sequence; identical to SEQ ID NO: 1780
  capsid_protein__Norovirus__AHZ13010

SEQ ID NO: 1784 - protein, 540 aa, Artificial Sequence; identical to SEQ ID NO: 1780
  capsid_protein__Norovirus__AHZ13015

SEQ ID NO: 1785 - protein, 540 aa, Artificial Sequence; identical to SEQ ID NO: 1780
  capsid_protein__Norovirus__AHZ13020

SEQ ID NO: 1786 - protein, 540 aa, Artificial Sequence; identical to SEQ ID NO: 1780
  capsid_protein__Norovirus__AHZ13023

SEQ ID NO: 1787 - protein, 514 aa, Artificial Sequence
  capsid_protein__Norovirus__AIC32559
MALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRVV

SEQ ID NO: 1788 - protein, 538 aa, Artificial Sequence
  capsid_protein__Norovirus__AID51474
MASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 1789 - protein, 538 aa, Artificial Sequence; identical to SEQ ID NO: 1788
  capsid_protein__Norovirus__AID51477

SEQ ID NO: 1790 - protein, 538 aa, Artificial Sequence; identical to SEQ ID NO: 1788
  capsid_protein__Norovirus__AID51480

SEQ ID NO: 1791 - protein, 538 aa, Artificial Sequence; identical to SEQ ID NO: 1788
  capsid_protein__Norovirus__AID51483

SEQ ID NO: 1792 - protein, 538 aa, Artificial Sequence; identical to SEQ ID NO: 1788
  capsid_protein__Norovirus__AID51486

SEQ ID NO: 1793 - protein, 538 aa, Artificial Sequence; identical to SEQ ID NO: 1788
  capsid_protein__Norovirus__AID51489

SEQ ID NO: 1794 - protein, 538 aa, Artificial Sequence; identical to SEQ ID NO: 1788
  capsid_protein__Norovirus__AID51492

SEQ ID NO: 1795 - protein, 538 aa, Artificial Sequence; identical to SEQ ID NO: 1788
  capsid_protein__Norovirus__AID51495

SEQ ID NO: 1796 - protein, 540 aa, Artificial Sequence
  capsid_protein__Norovirus__AIE40036
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTIEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1797 - protein, 548 aa, Artificial Sequence
  capsid_protein__Norovirus__AJW87644
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLIRSTSRASDQADTATPRLFNYYWHIQLDNLNGTPYDPAEDIPGPLGTPDFRGKVFGVASQRNPDTTTRAHEAKIDTTSGRFTPKLGSLEISTESDDFDQNKPTRFTPVGIGVDHEADFQQWTLPDYAGQFTHNMNLAPAVAPNFPGEQLLFFRSQLPSSGGRSNGILDCLVPQEWVQHFYQESAPSQSQVALVRYINPDTGRVLFEAKLHKLGFITIAKNGDSPITVPPNGYFRFESWVNPFYTLAPMGTGNGRRRIQ

SEQ ID NO: 1798 - protein, 540 aa, Artificial Sequence
  capsid_protein__Norovirus__ALG05457
MKMASNDAAPSNDGAAGLVPEGNNETLPLEPVAGAAIAAPVTGQNNIIDPWIRTNFVQAPNGEFTVSPRNSPGEILLNLELSPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 1799 - protein, 540 aa, Artificial Sequence
  capsid_protein__Norovirus__ALG05460
MKMASNDAAPSNDGAAGLVPEGNDETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHCSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTQFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 1800 - protein, 540 aa, Artificial Sequence
  capsid_protein__Norovirus__ALL73873
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 1801 - protein, 540 aa, Artificial Sequence; identical to SEQ ID NO: 1000
  capsid_protein__Norovirus__ALL73876

SEQ ID NO: 1802 - protein, 540 aa, Artificial Sequence
  capsid_protein__Norovirus__ALL73879
MKMASNDAAPSNDGAAGLVPEGNNETLPLEPVAGAAIAASVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 1803 - protein, 540 aa, Artificial Sequence; identical to SEQ ID NO: 1000
  capsid_protein__Norovirus__ALL73882

SEQ ID NO: 1804 - protein, 540 aa, Artificial Sequence; identical to SEQ ID NO: 1000
  capsid_protein__Norovirus__ALL73888

SEQ ID NO: 1805 - protein, 540 aa, Artificial Sequence
  capsid_protein__Norovirus__ALQ43927
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 1806 - protein, 540 aa, Artificial Sequence
  capsid_protein__Norovirus__ALQ43928
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRPL

SEQ ID NO: 1807 - protein, 540 aa, Artificial Sequence; identical to SEQ ID NO: 359
  capsid_protein__Norovirus__ALQ44123

SEQ ID NO: 1808 - protein, 540 aa, Artificial Sequence; identical to SEQ ID NO: 1000
  capsid_protein__Norovirus__ALQ44124

SEQ ID NO: 1809 - protein, 540 aa, Artificial Sequence; identical to SEQ ID NO: 1000
  capsid_protein__Norovirus__ALQ44125

SEQ ID NO: 1810 - protein, 547 aa, Artificial Sequence
  capsid_protein__Norovirus__BAB83514
MKMASSDAAPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTIGDGQPASHSEEEIMPMAFNIQREIMLENLDGTPYDPADDIPAVLGSPDFQGVIFGILSQRNTDGQTRAHEAKVDTRAARFAPKLGFVVATVESTDFHANQPSRFTPVGLGGDNNQDFNQWRLPAYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRAR

SEQ ID NO: 1811 - protein, 547 aa, Artificial Sequence
  capsid_protein__Norovirus__BAB83516
MKMASSDAPPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPGLTLDELSNSRFPAPIVQLYTNPHDNLIVQPQNGRCTIDGLLQGTTQLVSCNVCSFRGTMGEGQPAAHSEDEIMPMAFNVQREIMLENLDGSPYDPTDDIPAVLGSPDFQGVMFGILSQRNTDGQTRAHEAKVDTRAARFAPKLGFVVATVESTDFHANQPSRFTPVGLGGDTNRDFNQWQLPAYGGALTNNTNLAPPVMPVYPGEQLLFFRSQLPSSGGVVAGWLDCLLPQEWVQHFFQESATSQSDVALVRYVNPTTGRVLFEAKLHKQGFLTVAASGSYPLVVPADGYFRFESWVNQFYTLAPMGNGSGRRRAR

SEQ ID NO: 1812 - protein, 542 aa, Artificial Sequence
  capsid_protein__Norovirus__BAD72797
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGPPFDPSEDIPAPLGVPDFQGRVFGVISQRDKQNAAGHSEPANRGHDAVVPTYTAQYTPKLGQVQIGTWQTDDLQVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFVTVSSNTSAPVVVPANGYFRFDSWVNQFYSLAPMGAGNGRRRVQ

SEQ ID NO: 1813 - protein, 548 aa, Artificial Sequence
  capsid_protein__Norovirus__BAD72798
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFYYNQGSDSRLRLIAMLYTPLRANNSGDDVFTVSCRVLTRPSPDFSFNFLVPPTVESKTKPFTLPILTISEMSNSRFPVPIESLHTSPTENIVVQCQNGRVTLDGELMGTTQLLPSQICAFRGVLTRSTSRASDQADTATPRLFNYYWHVQLDNLNGTPYDPAEDIPGPLGTPDFRGKVFGVASQRNPDSTTRAHEAKVDTTAGRFTPKLGSLEISTESSDFDQNQPTRFTPVGIGVDNEADFQQWSLPDYSGQFTHNMNLAPAVAPNFPGEQLLFFRSQLPSSGGRSNGVLDCLVPQEWVQHFYQESAPAQTQVALVRYVNPDTGRVLFGAKLHKLGFMTIAKNGDSPITVPPNGYFRFESWVNPFYTLAPMGTGNGRRRIQ

SEQ ID NO: 1814 - protein, 548 aa, Artificial Sequence
  capsid_protein__Norovirus__BAD72799
MKMASNDAAPSNDGAAGLVPESNNEVMALEPVAGASLAAPVTGQTNIIDPWIRMNFVQAPNGEFTVSPRNSPGEVLLNLELGPELNPYLAHLSRMYNGYAGGMEVQIMLAGNAFTAGKLIFAAVPPHFPIENLSPPQITMFPHVIIDVRTLEPVLLPMPDIRNSFFHFIQRDEPKMRLVAMLYTPLRSNGSGDDVFTVSCRVLTRPTPDFDFTYLVPPTVESKSKPFTLPILTLGELTNSRFPLPIDVLYTNPNESAIVQCQNGRCTLGGELQGTAQLLPTGICAFRGKVTQQVQDEHRGTHWNMTVTKLNGTPFDPTEDVPAPLGTPDFSGQIYGVISQRNTNTVPGEGNLPANRAHEAVIATYSPKFTPKLGNIQFSTWETQDVSSGQPTKFTPVGLASVDANSHFDQWTLPSYSGALTLNMNLAPSVAPVFPGECLLFFRSFIPLKGGYGNPAIDCLMPQEWVQHLYQESAPSLSDVALVRYVNPETGRTLFEAKLHRNGFLTVARNSAGPVVAPTNGYFRFDSWVNQFYTLAPMGNGSGRRRIQ

SEQ ID NO: 1815 - protein, 540 aa, Artificial Sequence
  capsid_protein__Norovirus__BAD72800
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGNAFTAGKLVFAAIPPHFPVDNLSPGQITMFPHVIIDVRTLEPVLLPLPDVRNNFFHYNQQSDQRMRLIAMLYTPLRSNGSGDDVFTVSCRVLTRPSPDFHFHYLVPPTVESKTKPFSVPVLTLNELTNSRFPVPIDAMYTSPNDSIVVQPQNGRATIDGELLGTTQLIPSGICSFRGKITTHLADDRHLWNIQVSNLNGTPFDPTDDVPAPLGMPDFSGQIFGVVSERDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRIQ

SEQ ID NO: 1816 - protein, 539 aa, Artificial Sequence
  capsid_protein__Norovirus__BAD88558
MKMASNDVNPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKSFTVPVLTVEEMTNSRFPIPLEKLYTGPSSAFVVQPQNGRCTTDGVLLGTTQLSAVNICTFRGDVTHIAGSRNYTMNLASQNWNNYDPTEEIPAPLGIPDFVGKIQGLLTQTTRADGSTRAHKATVSTGSVHFTPKLGSVQFSTDTDNDFQPGQNTKFTPVGVIQDGDRHQNEPQQWVLPDYSGRTGHNVHLAPAVAPTFPGEQLLFFRSTMPGCSGYPNMNLDCLLPQEWVLHFYQESAPAQSDVALLRFVNPDTNRVLFECKLHKSGYITVAHTGQHDLILPPNGYFRFDSWVNQFYTLAPMGNGAGRRRAP

SEQ ID NO: 1817 - protein, 540 aa, Artificial Sequence
  capsid_protein__Norovirus__BAD98240
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 1818 - protein, 543 aa, Artificial Sequence
  capsid_protein__Norovirus__BAE43833
MMMASKDAPTNMDGTSGAGQLVPEASTAEPISMEPVAGAATAAATAGQVNMIDPWIMSNYVQAPQGEFTISPNNTPGDILFDLQLGPHLNPFLSHLAQMYNGWVGNMKVRVLLAGNAFTAGKIIISCVPPGFAAQNVSIAQATMFPHVIADVRVLEPIEVPLEDVRNVLFHNNDSTPTMRLICMLYTPLRASGSSSGTDPFVIAGRVLTCPSPDFNFLFLVPPNVEQKTKPFSVPNLPLNVLSNSRVPSLIKSMMVSQDHGQMVHFQIGRVTLDGQLQGTTPTSASQLCKIRGTVYHATGGQGLNLTEIDGTPYHAFESPAPIGFPDLGECDWHINASPANAFTDGSIIHRIDVAQDSTFAPHLGTIHYTNANYDANVSLICSLEWLSPPSGGAPKVNPWAIPRYGSTLTEAAQLAPPIYPPGFGEAIVFFMSDFPIANGSDGLSVPCTIPQEFVTHFVNEQAPTRGEAALLHYVDPDTHRNLGEFKLYPEGFMTCVPNSSGSGPQTLPINGVFTFISWVSRFYQLKPVGTTGPVRRLGIRRS

SEQ ID NO: 1819 - protein, 548 aa, Artificial Sequence
  capsid_protein__Norovirus__BAE48588
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTARKIIFAAIPPNFPIDNLSAAHITMCPHVIVDVRQLEPVNLPMPDVRNNFFHYNQGSDSRLRLIAMLYTPLRANNSGDDVFTVSCRVLTRPSPDFSFNFLVPPTLESKTKPFTLPILTISEMSNSRFPVPIDSLHTSPTENIVVQCQNGRVTLDGELMGTTQLLPSQICAFRGVLTRSTSRARDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDNEADFQQWSLPDYSGQFTHNMNLAPAVAPNFPGEQLLFFRSQLPSSGGRSNGILDCLVPQEWVQHFYQESAPSQTQVALVRYVNPDTGRVLFEAKLHKLGFTTIAKNGDSPITVPPNGYFRFESWVNPFYTLAPMGTGNGRRRNQ

SEQ ID NO: 1820 - protein, 548 aa, Artificial Sequence
  capsid_protein__Norovirus__BAE48589
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPYFPIDNLSAAQITMCPHVIVDVRQLEPVNLPMPDVRNNFFHYNQGSDSRLRLVAMLYTPLRANNSGDDVFTVSLRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1821 - protein, 548 aa, Artificial Sequence
  capsid_protein__Norovirus__BAE48590
MKMASNDATPSNDGAAGLVPEINNEAMALDPVAGAAIAAPLTGQQNIIDPWIMNNFVQAPGGEFTVSPRNSPGEVLLDLELGPEINPYLAHLARMYNGYAGGFEVQVVLAGNAFTAGKIIFAAIPPNFPIDNLSAAQITMCPHVIVDVRQLEPVNLPMPDVRNTFFHYNQGSDSRLRLIAMLYTPLRANNSGDDVFTVSCRVLTRPSPDFSFNFLVPPTVESKTKPFTLPILTISEMSNSRFPVPIDSLHTSPTESIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTTGRFTPKLGSLEISTESDDFDQNQPTRFTPVGIGVDHEADFQQWSLPDYSGQFTHNMNLAPAVAPNFRGEQLLFFRSQLPSSGGRSNGTLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1822 - protein, 547 aa, Artificial Sequence
  capsid_protein__Norovirus__BAE92970
MKMASNDASPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTLGDGQPASHSEEEIMPMAFNVQREIMLENLDGSPYDPTDDIPAVLGSPDFQGVVFGILSQRNTDGQTRAHEAKVDTRAARFAPKLGFVVATVESTDFHANQPSRFTPVGLGGDGNQDFNQWSLPAYGGALTNNTNLAPPAMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRSAR

SEQ ID NO: 1823 - protein, 540 aa, Artificial Sequence
  capsid_protein__Norovirus__BAE98191
MKMASNDASPSDGSTANLVPEVNNEVMALEPVVGAAIAAPVAGQQNVIDPWIRTNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVIHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1824 - protein, 540 aa, Artificial Sequence
  capsid_protein__Norovirus__BAE98194
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1825 - protein, 540 aa, Artificial Sequence
  capsid_protein__Norovirus__BAE98197
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1826 - protein, 540 aa, Artificial Sequence
  capsid_protein__Norovirus__BAF45861
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1827 - protein, 539 aa, Artificial Sequence
  capsid_protein__Norovirus__BAF74508
MKMASNDATPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTRGDGSTRAHKATVSTGSVHFTPKLGSVQYTTDTNNDFQTGQNTKFTPVGVIQDGDNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1828 - protein, 539 aa, Artificial Sequence
  capsid_protein__Norovirus__BAF74509
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1829 - protein, 539 aa, Artificial Sequence
  capsid_protein__Norovirus__BAF74510
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVFCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1830 - protein, 539 aa, Artificial Sequence
  capsid_protein__Norovirus__BAF74511
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLFTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMDLDCLLPQEWVQHFYQEAAPAQSDVALLRFVNPDTGRVLFECKLHKSGYVTVAHTGPHDLVIPPNGYFRFDSWINQFYTLAPMGNGAGRRRAL

SEQ ID NO: 1831 - protein, 539 aa, Artificial Sequence
  capsid_protein__Norovirus__BAF74512
MKMASNDATPSDGSTANLVPEVNNEVMALEPVVGAAIAARVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRSSAL

SEQ ID NO: 1832 - protein, 539 aa, Artificial Sequence
  capsid_protein__Norovirus__BAF74513
MKMASNDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1833 - protein, 540 aa, Artificial Sequence
  capsid_protein__Norovirus__BAF74514
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTLRGDVTHIAGTHNYTMNLASQNWNNYDPTEEIPAPLGTPDFVGRIQGVLTQTTRGDGSTRGHKATVSTGDVHFTPKLGSVQFNTDTNNDFEIGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1834 - protein, 539 aa, Artificial Sequence
  capsid_protein__Norovirus__BAF74515
MKMASNDANPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPVLTVEEMTNSRFPIPLEKLYTGPSSAIVVQPQNGRCTTDGVLLGTTQLSAVNICTFRGDVTHIAGSRNYTMNLASQNWNNYDPTEEIPAPLGTPDFVGKIQGLLTQTTRADGSTRAHKATVSTGSVHFTPKLGSVQFSTDTDNDFQPGQNTKFTPVGVIQDGDRHQNEPQQWVLPDFSGRTGHNVHLAPAVAPTFPGEQLLFFRSTMPGRSGYPNMNLDCLLPQEWVLHFYQESAPAQSDVALLRFVNPDTNRVLFECKLHKSGYITVAHTGHHDLILPPNGYFRFDSWVNQFYTLAPMGNGAGRRRAP

SEQ ID NO: 1835 - protein, 540 aa, Artificial Sequence
  capsid_protein__Norovirus__BAF74516
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNLYHYNQSNDPTIKLIAMLYTPLRANNAGEDVFTVSCRVLTRPSPDFDFIFLVPPTVESRTKPFTVPILTGEEMTNSRFPIPLEKLFTGPSGAFVVQPQNGRCTTDGVLLGTTQLLPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTSHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1836 - protein, 540 aa, Artificial Sequence
  capsid_protein__Norovirus__BAF74517
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1837 - protein, 540 aa, Artificial Sequence
  capsid_protein__Norovirus__BAF74518
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFNTDTNNDFETGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1838 - protein, 540 aa, Artificial Sequence
  capsid_protein__Norovirus__BAF74519
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYLTVAHTGQHDLVIPPNGYFRFDSWVNQFYTLAPMGNGTGRRRAL

SEQ ID NO: 1839 - protein, 540 aa, Artificial Sequence
  capsid_protein__Norovirus__BAF74520
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVIQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYITVAHTGQHDLVIPPNGYFRFDSWVNQFYTLAPMGNGTGRRRAL

SEQ ID NO: 1840 - protein, 540 aa, Artificial Sequence
  capsid_protein__Norovirus__BAF74521
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1841 - protein, 540 aa, Artificial Sequence
  capsid_protein__Norovirus__BAF74522
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFDTDTNSDFETGQNTKFTPVGVVQDGNGAHQNEPQQWVLPSYSGRTGHNAHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1842 - protein, 540 aa, Artificial Sequence; identical to SEQ ID NO: 487
  capsid_protein__Norovirus__BAF74523

SEQ ID NO: 1843 - protein, 540 aa, Artificial Sequence; identical to SEQ ID NO: 487
  capsid_protein__Norovirus__BAF74524

SEQ ID NO: 1844 - protein, 540 aa, Artificial Sequence; identical to SEQ ID NO: 487
  capsid_protein__Norovirus__BAF74525

SEQ ID NO: 1845 - protein, 540 aa, Artificial Sequence
  capsid_protein__Norovirus__BAF74526
MKMASNDATPSDGSTANLVPEVNTEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRTNNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1846 - protein, 540 aa, Artificial Sequence
  capsid_protein__Norovirus__BAF74527
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1847 - protein, 539 aa, Artificial Sequence
  capsid_protein__Norovirus__BAF95499
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPVPLEKLYTGPSSAFVVQPQNGRCTTDGVLLGTTQLSAVNICTFRGDVTHIAGSHDYTMNLASQNWNNYDPTEEIPAPLGTPDFVGKIQGVLTQTTREDGSTRAHKATVSTGSVHFTPKLGSVQYTTDTNNDFQTGQNTKFTPVGVIQDGSNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 1848 - protein, 539 aa, Artificial Sequence
  capsid_protein__Norovirus__BAF95501
MKMASNDVNPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPVLTVEEMTNSRFPIPLEKLYTGPSSAFVVQPQNGRCTTDGVLLGTTQLSAVNICTFRGDVTHIAGSRNYTMNLASQNWNNYDPTEEIPAPLGTPDFVGKIQGLLTQTTRADGSTRAHKATVSTGSVHFTPKLGSVQFSTDTDNDFQPGQNTKFTPVGVIQDGDRHQNEPQQWVLPDYSGRTGHNVHLAPAVAPTFPGEQLLFFRSTMPGCSGYPNMNLDCLLPQEWVLHFYQESAPAQSDVALLRFVNPDTNRVLFECKLHKSGYITVAHTGQHDLILPPNGYFRFDSWVNQFYTLAPMGNGAGRRRAP

SEQ ID NO: 1849 - protein, 540 aa, Artificial Sequence
  capsid_protein__Norovirus__BAF95503
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTKGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1850 - protein, 540 aa, Artificial Sequence
  capsid_protein__Norovirus__BAF95505
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPVLTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTKGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1851 - protein, 540 aa, Artificial Sequence; identical to SEQ ID NO: 1824
  capsid_protein__Norovirus__BAF95507

SEQ ID NO: 1852 - protein, 540 aa, Artificial Sequence
  capsid_protein__Norovirus__BAF95509
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1853 - protein, 540 aa, Artificial Sequence; identical to SEQ ID NO: 509
  capsid_protein__Norovirus__BAF95511

SEQ ID NO: 1854 - protein, 540 aa, Artificial Sequence
  capsid_protein__Norovirus__BAF95513
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1855 - protein, 540 aa, Artificial Sequence; identical to SEQ ID NO: 335
  capsid_protein__Norovirus__BAF95515

SEQ ID NO: 1856 - protein, 540 aa, Artificial Sequence
  capsid_protein__Norovirus__BAF95517
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1857 - protein, 540 aa, Artificial Sequence
  capsid_protein__Norovirus__BAF95519
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTTRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1858 - protein, 540 aa, Artificial Sequence
  capsid_protein__Norovirus__BAF95521
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1859 - protein, 540 aa, Artificial Sequence; identical to SEQ ID NO: 1035
  capsid_protein__Norovirus__BAF95523

SEQ ID NO: 1860 - protein, 540 aa, Artificial Sequence; identical to SEQ ID NO: 335
  capsid_protein__Norovirus__BAF95525

SEQ ID NO: 1861 - protein, 540 aa, Artificial Sequence
  capsid_protein__Norovirus__BAF95527
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFDVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRRAL

SEQ ID NO: 1862 - protein, 540 aa, Artificial Sequence
  capsid_protein__Norovirus__BAF95529
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1863 - protein, 540 aa, Artificial Sequence; identical to SEQ ID NO: 472
  capsid_protein__Norovirus__BAF95531

SEQ ID NO: 1864 - protein, 540 aa, Artificial Sequence; identical to SEQ ID NO: 1176
  capsid_protein__Norovirus__BAG30923

SEQ ID NO: 1865 - protein, 542 aa, Artificial Sequence
  capsid_protein__Norovirus__BAG34630
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKQNAAGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1866 - protein, 542 aa, Artificial Sequence
  capsid_protein__Norovirus__BAG34632
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMFTSPNEVISVQCQNGRCTLDGELQGTTQLQVSGICVFKGEVTAHLHDNDHLYNITITNLNGSPFDPSEDVPAPLGVPDFQGRVFGVISQRDNHNASGHNQPANRGHDAVVPTYTAQYTPKLGQIQIGTWQTDDLTVNQPVKFTPVGLNDVEHFNQWVVPRYAGALNLNTNLAPSVAPVFPGERLLFFRSYLPLKGGYGNPVIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 1867 - protein, 542 aa, Artificial Sequence
  capsid_protein__Norovirus__BAG34634
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNASGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1868 - protein, 542 aa, Artificial Sequence
  capsid_protein__Norovirus__BAG34636
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMFTSPNEVISVQCQNGRCTLDGELQGSTQLQVSGICAFKGEVTAHLHDNDHLYNITITNLNGSPFDPSEDVPAPLGVPDFQGRVFGVISQRDNHNASGHNQPANRGHDAVVPTYTSQYTPKLGQIQIGTWQTDDLTVNQPVKFTPVGLNDVEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 1869 - protein, 542 aa, Artificial Sequence; identical to SEQ ID NO: 408
  capsid_protein__Norovirus__BAG34638

SEQ ID NO: 1870 - protein, 542 aa, Artificial Sequence; identical to SEQ ID NO: 408
  capsid_protein__Norovirus__BAG34640

SEQ ID NO: 1871 - protein, 542 aa, Artificial Sequence; identical to SEQ ID NO: 408
  capsid_protein__Norovirus__BAG34642

SEQ ID NO: 1872 - protein, 542 aa, Artificial Sequence; identical to SEQ ID NO: 408
  capsid_protein__Norovirus__BAG34644

SEQ ID NO: 1873 - protein, 542 aa, Artificial Sequence; identical to SEQ ID NO: 408
  capsid_protein__Norovirus__BAG34646

SEQ ID NO: 1874 - protein, 542 aa, Artificial Sequence
  capsid_protein__Norovirus__BAG34648
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGSTQLQVSGICAFKGEVTAHLHDNDHLYNVTITNLNGSPFDPSEDIPAPLGVPDFQGRVFGVISQRDKHNSPGHNEPANRGHDAVVPTYTSQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1875 - protein, 542 aa, Artificial Sequence; identical to SEQ ID NO: 408
  capsid_protein__Norovirus__BAG34650

SEQ ID NO: 1876 - protein, 542 aa, Artificial Sequence
  capsid_protein__Norovirus__BAG34652
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNEPANRGHDAVVPTYTPQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSISEVALVRYINPDTGRALFEAKLHRAGFMTVSSNTSAPVVVPANGYFRFDSWVNQFYSLAPMGTGNGRRRVQ

SEQ ID NO: 1877 - protein, 542 aa, Artificial Sequence
  capsid_protein__Norovirus__BAG34654
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNESANRGHDAVVPTYTSQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1878 - protein, 542 aa, Artificial Sequence
  capsid_protein__Norovirus__BAG34656
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNEPANRGHDAVVPTYTSQYTPKLGQIQIGTWQTDDLIVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1879 - protein, 542 aa, Artificial Sequence; identical to SEQ ID NO: 408
  capsid_protein__Norovirus__BAG34658

SEQ ID NO: 1880 - protein, 542 aa, Artificial Sequence
  capsid_protein__Norovirus__BAG34662
MKMASNDAAPSTDGAAGLVPESNSEVMALEPVAGAALAAPVTGQTNIIDPWIRSNFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLQNDDHLYNITITNLNGSPFDPSEDIPAPLGVPDFQGRVFGVITQRDKQNATGQNQPANRGHDAVVPTYTAQYTPKLGQIQIGTWQTDDLKVNQPVKFTPVGLNDTEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 1881 - protein, 542 aa, Artificial Sequence
  capsid_protein__Norovirus__BAG34664
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDTPAPLGVPDFQGRVFGIISQRDKQNATGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1882 - protein, 542 aa, Artificial Sequence; identical to SEQ ID NO: 408
  capsid_protein__Norovirus__BAG34666

SEQ ID NO: 1883 - protein, 542 aa, Artificial Sequence
  capsid_protein__Norovirus__BAG34668
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRILEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNEPANRGHDAVVPTYTSQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1884 - protein, 542 aa, Artificial Sequence
  capsid_protein__Norovirus__BAG34670
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGSTQLQVSGICAFKGEVTAHLHDNDHLYNVTITNLNGSPFDPSEDIPAPLGVPDFQGRVFGVISQRDKHNSPGHNEPANRGHDAVVPTYTSQYTPKLGQIQIGTWQTDDLTVNQPAKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1885 - protein, 540 aa, Artificial Sequence
  capsid_protein__Norovirus__BAG55289
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNNHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1886 - protein, 542 aa, Artificial Sequence
  capsid_protein__Norovirus__BAG68707
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKQNATGHNEPANRGHDVVVPTYTAQYTPKLGQIQIGTWQTDDLTVNQPAKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1887 - protein, 542 aa, Artificial Sequence
  capsid_protein__Norovirus__BAG68708
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDSKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKQNATGHSEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVAPANGYFRFDSWVNQFYSLAPMGTGNGRRRVQ

SEQ ID NO: 1888 - protein, 542 aa, Artificial Sequence
  capsid_protein__Norovirus__BAG68709
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKQNATGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1889 - protein, 542 aa, Artificial Sequence
  capsid_protein__Norovirus__BAG68711
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHIASGHNEPANRGHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGNPAIDCLLPQEWVQHFYQESAPSMSEVALVRYINPDTGRALFEAKLHRAGFMTVSSNTSAPVVVPANGYFRFDSWVNQFYSLAPMGTGNGRRRTQ

SEQ ID NO: 1890 - protein, 542 aa, Artificial Sequence
  capsid_protein__Norovirus__BAG68712
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNASGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1891 - protein, 542 aa, Artificial Sequence; identical to SEQ ID NO: 1890
  capsid_protein__Norovirus__BAG68713

SEQ ID NO: 1892 - protein, 542 aa, Artificial Sequence
  capsid_protein__Norovirus__BAG68714
MKMASNDAAPSTDGAAGLVPESSNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNASGHNEPANRGHDAVVPTYTAQYTPKLGQVQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1893 - protein, 542 aa, Artificial Sequence
  capsid_protein__Norovirus__BAG68715
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 1894 - protein, 542 aa, Artificial Sequence; identical to SEQ ID NO: 414
  capsid_protein__Norovirus__BAG68716

SEQ ID NO: 1895 - protein, 548 aa, Artificial Sequence
  capsid_protein__Norovirus__BAG68799
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDATTRAHEAKIDTASGRFTPKLGSLEISTESDDFDQNKPTRFTPVGIGVDHEEDFQQWTLPDYAGQFTHNMNLAPAVAPNFPGEQLLFFRSQLPSSGGRSNGILDCLVPQEWVQHFYQESAPSQSQVALVRYINPDTGRVLFEAKLHKLGFMTIAKNGDSPITVPPNGYFRFESWVNPFYTLAPMGTGNGRRRIQ

SEQ ID NO: 1896 - protein, 548 aa, Artificial Sequence
  capsid_protein__Norovirus__BAG68800
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNTFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFDYYWHIQLDNLNGTPYDPAEDIPGPLGTPDFRGKVFGVASQRNPDTTTRAHEAKIDTASGRFTPKLGSLEISTESDDFDQNKPTRFTPVGIGVDHEEDFQQWTLPNYAGQFTHNMNLAPAVAPNFPGEQVLFFRSQLPSSGGRSNGILDCLVPQEWVQHFYQESAPSQSQVALVRYVNPDTGRVLFEAKLHKLGFMTIARNGDSPITVPPNGYFRFESWVNPFYTLAPMGTGNGRRRIQ

SEQ ID NO: 1897 - protein, 540 aa, Artificial Sequence; identical to SEQ ID NO: 488
  capsid_protein__Norovirus__BAG68801

SEQ ID NO: 1898 - protein, 540 aa, Artificial Sequence
  capsid_protein__Norovirus__BAG68802
MKMASNDATPSDGSTANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIANTQNYTMNLASQNWNNYDPTEEIPAPLGTPDFVGRIQGVLTQTTRGDGSTRGHKATVSTGSVHFTPKLGSVQFSTDTSNDLETGQNTRFTPVGVVQDGGTTHRNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1899 - protein, 540 aa, Artificial Sequence
  capsid_protein__Norovirus__BAG68803
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1900 - protein, 540 aa, Artificial Sequence; identical to SEQ ID NO: 472
  capsid_protein__Norovirus__BAG68804

SEQ ID NO: 1901 - protein, 540 aa, Artificial Sequence
  capsid_protein__Norovirus__BAG68805
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEVPAPLGTPDFMGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVSPDTGRVLFECKLHKSGYVTVAHTGQHDLVIPPNGYFRFDSWVNQFYTLAPMGNGTGRRRAL

SEQ ID NO: 1902 - protein, 540 aa, Artificial Sequence
  capsid_protein__Norovirus__BAG68806
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFIVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYLGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1903 - protein, 548 aa, Artificial Sequence
  capsid_protein__Norovirus__BAG68807
MKMASSDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 1904 - protein, 540 aa, Artificial Sequence
  capsid_protein__Norovirus__BAG68808
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTDSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDLETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1905 - protein, 540 aa, Artificial Sequence
  capsid_protein__Norovirus__BAG68809
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTDSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDLETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 1906 - protein, 540 aa, Artificial Sequence
  capsid_protein__Norovirus__BAG68810
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1907 - protein, 540 aa, Artificial Sequence
  capsid_protein__Norovirus__BAG68811
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIANTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGGDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1908 - protein, 540 aa, Artificial Sequence; identical to SEQ ID NO: 1035
  capsid_protein__Norovirus__BAG68812

SEQ ID NO: 1909 - protein, 540 aa, Artificial Sequence
  capsid_protein__Norovirus__BAG68813
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNSYAGGFEVQVILAGNAFTAGKIIFAAVPPNFPIEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPTPVEKLFTGPSSAFIVQPQNGRCTIDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETRQNTRFTPVGVIQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVMFECKLHKSGYITVAHTGQHDLVIPPNGYFRFDAWVNQFYTLAPMGNGTGRRRAL

SEQ ID NO: 1910 - protein, 548 aa, Artificial Sequence
  capsid_protein__Norovirus__BAG68814
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDTTTRAHEAKIDTTSGRFTPKLGSLEISTESDDFDQNKPTRFTPVGIGVDREVDFQQWALPDYAGQFTHNMNLAPAVAPNFPGEQLLFFRSQLPSSGGRSNGILDCLVPQEWVQHFYQESAPSQSQVALVRYINPDTGRVLFEAKLHKLGFMTIAKNGDSPITVPPNGYFRFESWVNPFYTLAPMGTGNGRRRIQ

SEQ ID NO: 1911 - protein, 548 aa, Artificial Sequence
  capsid_protein__Norovirus__BAG68815
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDTTTRAHEAKIDTTSGRFTPKLGSLEISTESDDFDQNKPTRFTPVGIGVDHEVDFQQWALPDYAGQFTHNMNLAPAVAPNFPGEQLLFFRSQLPSSGGRSNGILDCLVPQEWVQHFYQESAPSQSQVALVRYINPDTGRVLFEAKLHKLGFMTIAKNGDSPITVPPNGYFRFESWVNPFYTLAPMGTGNGRRRIQ

SEQ ID NO: 1912 - protein, 540 aa, Artificial Sequence
  capsid_protein__Norovirus__BAG68816
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRGDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1913 - protein, 541 aa, Artificial Sequence
  capsid_protein__Norovirus__BAH04374
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKKGEKLKVTTFEMILGPTTNVDQVPYQGRVYASLTAAASLDLVDGRVRAVPRSVYGFQDVVPEYNDGLLVPLAPPIGPFLPGEVLLRFRTYMRQIDSTDAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1914 - protein, 541 aa, Artificial Sequence
  capsid_protein__Norovirus__BAH04377
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGIGEVATFTLIEQDGSAYVPGDRAAPLGYPDFSGQLEIEVQTETTKKGEKLKVTTFEMILGPTTNVDQVPYQGRVYASLTAAASLDLVDGRVRAVPRSVYGFQDVVPEYNDGLLVPLAPPIGPFLPGEVLLRFRTYMRQIDSTDAAAEAIDCALPQEFVSWFASNAFTVQSEALLLRYRNTLTGQLLFECKLYSEGYIALSYSGSGPLTFPTDGFFEVVSWVPRLYQLASVGSLATGRTLKQ

SEQ ID NO: 1915 - protein, 540 aa, Artificial Sequence; identical to SEQ ID NO: 1175
  capsid_protein__Norovirus__BAH29786

SEQ ID NO: 1916 - protein, 540 aa, Artificial Sequence
  capsid_protein__Norovirus__BAH30707
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHISGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1917 - protein, 550 aa, Artificial Sequence
  capsid_protein__Norovirus__BAL40869
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAVDSTDSPQRARDHPLHVQVKNLDGTQYDPTDDIPAVLGAIDFKGTVFGVASQRDVSGTQEQGHYATRAHEAHIDTTDPKYAPKLGTILIKSESPDFNTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 1918 - protein, 547 aa, Artificial Sequence
  capsid_protein__Norovirus__BAL40870
MKMASSDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVAPPNGYFRFEAWVNQFYTLTPMGTGQGRRRNQ

SEQ ID NO: 1919 - protein, 547 aa, Artificial Sequence
  capsid_protein__Norovirus__BAL40871
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGDDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSMVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 1920 - protein, 547 aa, Artificial Sequence
  capsid_protein__Norovirus__BAL40872
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSVGATRAHEVHIDTTNPRYTPKLGSVLMNSESSDFDDGQPTCFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 1921 - protein, 547 aa, Artificial Sequence
  capsid_protein__Norovirus__BAL40873
MKMASNDAAPSNDGAANLVPEANNEVMALEPVAGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSVGATRAHEVHIDTTNPRYTPKLGSVLMHSESSDFDDGQPISFTPIGMGADDWHQWELPEYSGHLTLNMNLAPAVAPAFPGERILFFRSVVPSAGGYGSGQIDCLIPQEWVQHFYQEAAPSQSAVALVRYVNPDTGRNIFEAKLHREGFLTVANSGNNPIVVPPNGYFRFEAWVNQFYTLTPMGTGQGRRRVQ

SEQ ID NO: 1922 - protein, 541 aa, Artificial Sequence
  capsid_protein__Norovirus__BAL60900
MRMSDGAAPKANGSEASGQDLVLTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGEVATFTLIEQDGSAYVPGERAAPLGYPDFSGQLEIEVQTETTKRGEKLKVTTFEMILGPTTNVDQAPYQGRVYASLSAAASLDLVDGRVRAVPRSIYGFQDVIPEYNDGLLVPLAPPIGPFLPGEVLLRFRTYMRQVDSSDAAAEAIDCALPQEFVSWFASNGFTVQSEALLLRYRNTLTGQLLFECKLYSEGYIALSYSGSGPLTFPTDGFFEVVSWVPRLYQLASVGSLVTGRTLKQ

SEQ ID NO: 1923 - protein, 540 aa, Artificial Sequence
  capsid_protein__Norovirus__BAQ55211
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTSTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSGAHRNEPQQWVLPNYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1924 - protein, 540 aa, Artificial Sequence; identical to SEQ ID NO: 328
  capsid_protein__Norovirus__BAQ55212

SEQ ID NO: 1925 - protein, 539 aa, Artificial Sequence
  capsid_protein__Norovirus__BAQ55213
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTSTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1926 - protein, 540 aa, Artificial Sequence
  capsid_protein__Norovirus__BAQ55214
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTSTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSGAHRNEPQQWVLPDYSGKTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1927 - protein, 539 aa, Artificial Sequence
  capsid_protein__Norovirus__BAQ55215
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1928 - protein, 539 aa, Artificial Sequence
  capsid_protein__Norovirus__BAQ55216
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQITMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFDTDTNNDLETGQNTRFTPVGVIQDGSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1929 - protein, 539 aa, Artificial Sequence
  capsid_protein__Norovirus__BAQ55217
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTHTYRMNLASQNWNNYDPTEEIPAPLGTPDFVGKIQGMLTQTTKGDGSTRGHKATVSTGSVDFTPKLGSVQFATDTNNDFETGQNTRFTPVGVIQDGSAHRNEPQQWVLPDYSGKTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1930 - protein, 540 aa, Artificial Sequence
  capsid_protein__Norovirus__BAQ55218
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPNTHTYRMNLASQNWNNYDPTEEIPAPLGTPDFVGKIQGMLTQTTKGDGSTRGHKATVSTGSVDFTPKLGSVQFTTDTDNDFETGQNTRFTPVGVIQDGNGAHRNEPQQWVLPDYSGGTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRRAL

SEQ ID NO: 1931 - protein, 540 aa, Artificial Sequence; identical to SEQ ID NO: 541
  capsid_protein__Norovirus__BAR47396

SEQ ID NO: 1932 - protein, 540 aa, Artificial Sequence; identical to SEQ ID NO: 1032
  capsid_protein__Norovirus__BAR47397

SEQ ID NO: 1933 - protein, 540 aa, Artificial Sequence
  capsid_protein__Norovirus__BAR47398
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDQGRVLFECKLHKSGYVTVAHTGQHDLVIPPNGYFRFDSWVNQFYTLAPMGNGTGRRRAL

SEQ ID NO: 1934 - protein, 540 aa, Artificial Sequence; identical to SEQ ID NO: 1072
  capsid_protein__Norovirus__BAR47400

SEQ ID NO: 1935 - protein, 540 aa, Artificial Sequence
  capsid_protein__Norovirus__BAR47401
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPTLTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1936 - protein, 540 aa, Artificial Sequence
  capsid_protein__Norovirus__BAR47403
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATIYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1937 - protein, 540 aa, Artificial Sequence; identical to SEQ ID NO: 621
  capsid_protein__Norovirus__BAR47404

SEQ ID NO: 1938 - protein, 540 aa, Artificial Sequence
  capsid_protein__Norovirus__BAR47405
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSTPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1939 - protein, 540 aa, Artificial Sequence; identical to SEQ ID NO: 1231
  capsid_protein__Norovirus__BAR47406

SEQ ID NO: 1940 - protein, 540 aa, Artificial Sequence
  capsid_protein__Norovirus__BAR47407
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSGNYTMNLASVNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1941 - protein, 540 aa, Artificial Sequence
  capsid_protein__Norovirus__BAR47408
MKMASNDANPSDGSAANLVPEVNNEVMALEPVVGAAIAAPVAGQQNVIDPWIKNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1942 - protein, 540 aa, Artificial Sequence; identical to SEQ ID NO: 1357
  capsid_protein__Norovirus__BAR47410

SEQ ID NO: 1943 - protein, 540 aa, Artificial Sequence
  capsid_protein__Norovirus__BAR47412
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRIQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVA

SEQ ID NO: 1944 - protein, 540 aa, Artificial Sequence
  capsid_protein__Norovirus__BAR47413
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRIQFETDTDHDFEANQNTKFTPVGVIQDGGTTHRNEPQQWMLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVA

SEQ ID NO: 1945 - protein, 540 aa, Artificial Sequence; identical to SEQ ID NO: 1944
  capsid_protein__Norovirus__BAR47414

SEQ ID NO: 1946 - protein, 540 aa, Artificial Sequence; identical to SEQ ID NO: 1944
  capsid_protein__Norovirus__BAR47415

SEQ ID NO: 1947 - protein, 540 aa, Artificial Sequence; identical to SEQ ID NO: 871
  capsid_protein__Norovirus__BAR47417

SEQ ID NO: 1948 - protein, 540 aa, Artificial Sequence
  capsid_protein__Norovirus__BAR47418
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1949 - protein, 540 aa, Artificial Sequence
  capsid_protein__Norovirus__BAR47421
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 1950 - protein, 540 aa, Artificial Sequence; identical to SEQ ID NO: 677
  capsid_protein__Norovirus__BAR47422

SEQ ID NO: 1951 - protein, 540 aa, Artificial Sequence
  capsid_protein__Norovirus__BAR47423
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRRAL

SEQ ID NO: 1952 - protein, 540 aa, Artificial Sequence; identical to SEQ ID NO: 679
  capsid_protein__Norovirus__BAR47424

SEQ ID NO: 1953 - protein, 540 aa, Artificial Sequence; identical to SEQ ID NO: 957
  capsid_protein__Norovirus__BAR47426

SEQ ID NO: 1954 - protein, 540 aa, Artificial Sequence; identical to SEQ ID NO: 621
  capsid_protein__Norovirus__BAS53731

SEQ ID NO: 1955 - protein, 540 aa, Artificial Sequence
  capsid_protein__Norovirus__BAS53732
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRAKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1956 - protein, 540 aa, Artificial Sequence
  capsid_protein__Norovirus__BAS53733
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLSWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1957 - protein, 540 aa, Artificial Sequence
  capsid_protein__Norovirus__BAS53734
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQFLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1958 - protein, 540 aa, Artificial Sequence
  capsid_protein__Norovirus__BAS53945
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTTPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 1959 - protein, 543 aa, Artificial Sequence
  capsid_protein__Norovirus__CAK22261
MMMASKDASPSADGANGAGQLVPEVNNAEPLPLDPVAGASTALATAGQVNMIDPWIFNNFVQAPQGEFTISPNNTPGDILFDLQLGPHLNPFLAHLSQMYNGWVGNMRVRVILAGNAFTAGKVIVCCVPPGFQSRTLSIAQATLFPHIIADVRTLEPIEIPLEDVRNTLYHTNDNQPTMRLLCMLYTPLRTGGGSGGTDAFVVAGRVLTCPSSDFNFLFLVPPTVEQKTRPFSVPNIPLQLLSNSRVPNLIQSMVLSPDQAQNVQFQNGRCTTDGQLLGTTPVSVSQILKFRGKVSAGSRVINLTELDGSPFLAFEAPAPTGFPDLGTSDWHVEMSLNSNSQSSGNPILLRDIQPNSSDFVPHLGSVAVTTAIDVAGDYTGTIQWTSQPSNVTPVPDVNFWTIPQYGSNLAEASQLAPVVYPPGFGEAIVYFMSPIPGPNTAHKPNLVPCLLPQEFVTHFVSEQAPSMGEAALVHYVDPDTNRNLGEFKLYPEGFITCVPNGTGPQQLPLNGVFVFASWVSRFYQLKPVGTASSARGRLGVRR

SEQ ID NO: 1960 - protein, 556 aa, Artificial Sequence
  capsid_protein__Norovirus__CAR95870
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGERHTNIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRRGRVRFQ

SEQ ID NO: 1961 - protein, 540 aa, Artificial Sequence; identical to SEQ ID NO: 1107
  capsid_protein_VP1__Norovirus__ADB27914

SEQ ID NO: 1962 - protein, 540 aa, Artificial Sequence; identical to SEQ ID NO: 5
  capsid_protein_VP1__Norovirus__ADI45809

SEQ ID NO: 1963 - protein, 540 aa, Artificial Sequence; identical to SEQ ID NO: 562
  capsid_protein_VP1__Norovirus__ADI45810

SEQ ID NO: 1964 - protein, 540 aa, Artificial Sequence; identical to SEQ ID NO: 6
  capsid_protein_VP1__Norovirus__ADI45813

SEQ ID NO: 1965 - protein, 535 aa, Artificial Sequence; identical to SEQ ID NO: 228
  capsid_protein_VP1__Norovirus__ADT70684

SEQ ID NO: 1966 - protein, 535 aa, Artificial Sequence; identical to SEQ ID NO: 507
  capsid_protein_VP1__Norovirus__ADZ24003

SEQ ID NO: 1967 - protein, 540 aa, Artificial Sequence; identical to SEQ ID NO: 226
  capsid_protein_VP1__Norovirus__AFI08234

SEQ ID NO: 1968 - protein, 540 aa, Artificial Sequence; identical to SEQ ID NO: 15
  capsid_protein_VP1__Norovirus__AFI08237

SEQ ID NO: 1969 - protein, 540 aa, Artificial Sequence; identical to SEQ ID NO: 50
  capsid_protein_VP1__Norovirus__AFI08243

SEQ ID NO: 1970 - protein, 530 aa, Artificial Sequence; identical to SEQ ID NO: 163
  capsid_protein_VP1__Norovirus__AFJ38516

SEQ ID NO: 1971 - protein, 539 aa, Artificial Sequence; identical to SEQ ID NO: 456
  capsid_protein_VP1__Norovirus__AFJ38519

SEQ ID NO: 1972 - protein, 540 aa, Artificial Sequence; identical to SEQ ID NO: 20
  capsid_protein_VP1__Norovirus__AFW15937

SEQ ID NO: 1973 - protein, 540 aa, Artificial Sequence; identical to SEQ ID NO: 19
  capsid_protein_VP1__Norovirus__AFW15939

SEQ ID NO: 1974 - protein, 540 aa, Artificial Sequence; identical to SEQ ID NO: 621
  capsid_protein_VP1__Norovirus__AFW15942

SEQ ID NO: 1975 - protein, 540 aa, Artificial Sequence; identical to SEQ ID NO: 21
  capsid_protein_VP1__Norovirus__AFW15943

SEQ ID NO: 1976 - protein, 540 aa, Artificial Sequence; identical to SEQ ID NO: 22
  capsid_protein_VP1__Norovirus__AFW15946

SEQ ID NO: 1977 - protein, 548 aa, Artificial Sequence; identical to SEQ ID NO: 605
  capsid_protein_VP1__Norovirus__AFX71656

SEQ ID NO: 1978 - protein, 542 aa, Artificial Sequence; identical to SEQ ID NO: 603
  capsid_protein_VP1__Norovirus__AFX71659

SEQ ID NO: 1979 - protein, 540 aa, Artificial Sequence; identical to SEQ ID NO: 48
  capsid_protein_VP1__Norovirus__AFX81124

SEQ ID NO: 1980 - protein, 540 aa, Artificial Sequence; identical to SEQ ID NO: 69
  capsid_protein_VP1__Norovirus__AFX81133

SEQ ID NO: 1981 - protein, 540 aa, Artificial Sequence; identical to SEQ ID NO: 217
  capsid_protein_VP1__Norovirus__AFX81151

SEQ ID NO: 1982 - protein, 540 aa, Artificial Sequence; identical to SEQ ID NO: 268
  capsid_protein_VP1__Norovirus__AFX81160

SEQ ID NO: 1983 - protein, 540 aa, Artificial Sequence; identical to SEQ ID NO: 150
  capsid_protein_VP1__Norovirus__AFX81175

SEQ ID NO: 1984 - protein, 540 aa, Artificial Sequence; identical to SEQ ID NO: 65
  capsid_protein_VP1__Norovirus__AFX81184

SEQ ID NO: 1985 - protein, 540 aa, Artificial Sequence; identical to SEQ ID NO: 102
  capsid_protein_VP1__Norovirus__AFX81187

SEQ ID NO: 1986 - protein, 540 aa, Artificial Sequence; identical to SEQ ID NO: 309
  capsid_protein_VP1__Norovirus__AFX81217

SEQ ID NO: 1987 - protein, 540 aa, Artificial Sequence; identical to SEQ ID NO: 299
  capsid_protein_VP1__Norovirus__AFX81220

SEQ ID NO: 1988 - protein, 540 aa, Artificial Sequence; identical to SEQ ID NO: 121
  capsid_protein_VP1__Norovirus__AFX81223

SEQ ID NO: 1989 - protein, 540 aa, Artificial Sequence; identical to SEQ ID NO: 58
  capsid_protein_VP1__Norovirus__AFX81235

SEQ ID NO: 1990 - protein, 540 aa, Artificial Sequence; identical to SEQ ID NO: 100
  capsid_protein_VP1__Norovirus__AFX81259

SEQ ID NO: 1991 - protein, 540 aa, Artificial Sequence; identical to SEQ ID NO: 89
  capsid_protein_VP1__Norovirus__AFX81280

SEQ ID NO: 1992 - protein, 540 aa, Artificial Sequence; identical to SEQ ID NO: 241
  capsid_protein_VP1__Norovirus__AFX81286

SEQ ID NO: 1993 - protein, 540 aa, Artificial Sequence; identical to SEQ ID NO: 97
  capsid_protein_VP1__Norovirus__AFX81310

SEQ ID NO: 1994 - protein, 540 aa, Artificial Sequence; identical to SEQ ID NO: 318
  capsid_protein_VP1__Norovirus__AGE89469

SEQ ID NO: 1995 - protein, 540 aa, Artificial Sequence; identical to SEQ ID NO: 282
  capsid_protein_VP1__Norovirus__AGE89484

SEQ ID NO: 1996 - protein, 540 aa, Artificial Sequence; identical to SEQ ID NO: 119
  capsid_protein_VP1__Norovirus__AGE89487

SEQ ID NO: 1997 - protein, 540 aa, Artificial Sequence; identical to SEQ ID NO: 155
  capsid_protein_VP1__Norovirus__AGE89619

SEQ ID NO: 1998 - protein, 540 aa, Artificial Sequence; identical to SEQ ID NO: 264
  capsid_protein_VP1__Norovirus__AGE89670

SEQ ID NO: 1999 - protein, 540 aa, Artificial Sequence; identical to SEQ ID NO: 158
  capsid_protein_VP1__Norovirus__AGE99596

SEQ ID NO: 2000 - protein, 550 aa, Artificial Sequence; identical to SEQ ID NO: 601
  capsid_protein_VP1__Norovirus__AGE99599

SEQ ID NO: 2001 - protein, 539 aa, Artificial Sequence; identical to SEQ ID NO: 405
  capsid_protein_VP1__Norovirus__AGE99612

SEQ ID NO: 2002 - protein, 548 aa, Artificial Sequence; identical to SEQ ID NO: 606
  capsid_protein_VP1__Norovirus__AGI17609

SEQ ID NO: 2003 - protein, 530 aa, Artificial Sequence; identical to SEQ ID NO: 164
  capsid_protein_VP1__Norovirus__AGM33211

SEQ ID NO: 2004 - protein, 530 aa, Artificial Sequence; identical to SEQ ID NO: 169
  capsid_protein_VP1__Norovirus__AGM33223

SEQ ID NO: 2005 - protein, 540 aa, Artificial Sequence; identical to SEQ ID NO: 199
  capsid_protein_VP1__Norovirus__AGT17839

SEQ ID NO: 2006 - protein, 538 aa, Artificial Sequence; identical to SEQ ID NO: 198
  capsid_protein_VP1__Norovirus__AGX85910

SEQ ID NO: 2007 - protein, 540 aa, Artificial Sequence; identical to SEQ ID NO: 669
  capsid_protein_VP1__Norovirus__AHI59162

SEQ ID NO: 2008 - protein, 539 aa, Artificial Sequence; identical to SEQ ID NO: 626
  capsid_protein_VP1__Norovirus__AHI59165

SEQ ID NO: 2009 - protein, 540 aa, Artificial Sequence; identical to SEQ ID NO: 215
  capsid_protein_VP1__Norovirus__AHX22044

SEQ ID NO: 2010 - protein, 540 aa, Artificial Sequence; identical to SEQ ID NO: 248
  capsid_protein_VP1__Norovirus__AII02587

SEQ ID NO: 2011 - protein, 548 aa, Artificial Sequence; identical to SEQ ID NO: 233
  capsid_protein_VP1__Norovirus__AII02617

SEQ ID NO: 2012 - protein, 548 aa, Artificial Sequence; identical to SEQ ID NO: 321
  capsid_protein_VP1__Norovirus__AIS24556

SEQ ID NO: 2013 - protein, 540 aa, Artificial Sequence; identical to SEQ ID NO: 498
  capsid_protein_VP1__Norovirus__BAI49908

SEQ ID NO: 2014 - protein, 540 aa, Artificial Sequence; identical to SEQ ID NO: 335
  capsid_protein_VP1__Norovirus__BAI49913

SEQ ID NO: 2015 - protein, 540 aa, Artificial Sequence; identical to SEQ ID NO: 342
  capsid_protein_VP1__Norovirus__BAI49922

SEQ ID NO: 2016 - protein, 535 aa, Artificial Sequence; identical to SEQ ID NO: 350
  capsid_protein_VP1__Norovirus__BAJ25074

SEQ ID NO: 2017 - protein, 538 aa, Artificial Sequence; identical to SEQ ID NO: 360
  capsid_protein_VP1__Norovirus__BAP33934

SEQ ID NO: 2018 - protein, 540 aa, Artificial Sequence
  major_capsid_protein__Norovirus__ABQ63283
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFSVPILTVEEMTNSRFPIPLEKLFTGPSSTIVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVNFTPKLGRIQFSTDTSNDFETGQSTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2019 - protein, 540 aa, Artificial Sequence
  major_capsid_protein__Norovirus__ABV55634
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLKWNKYDPTEEIPAPLGTPDFVGKIQGVLTQTTKGDGSTRGHKATIYTGSAPFTPKLGSVQFSTDTENDFETHQNTKFTPVGVTQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2020 - protein, 540 aa, Artificial Sequence
  major_capsid_protein__Norovirus__ACV41093
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTGRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKPGYVTVAHTGQHDLVIPPNGYFRFDSWVNQFYTLAPMGNGTGRRRAL

SEQ ID NO: 2021 - protein, 544 aa, Artificial Sequence
  major_capsid_protein__Norovirus__ACV41096
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 2022 - protein, 580 aa, Artificial Sequence
  major_capsid_protein__Norovirus__ACV88130
MKMASNDATAPSQDGAANLVPESQHEVLALEPVAGAALAAPVAGQFNAIDPWIKQNFVQAPAGEFTVSPRNAPGEILMDLELGPELSPFLAHLAQMYNAYAGGMEVQIILAGNAFTAGKIIVCAVPPNFPPDRLSASQATNFPHVIMDVRTLEPVILPLPDVRAGFFHYNQLREPRMRLMALLYTPLRANGTGDDAFTVSCRVLTRPMQDFEFMFLVPPTVESRVTPFSVPTYPVVEMTNSRWPARISGMHVNANQTLAVQFQNGRCTLDGQLMGTTQLCAADVCRMRGRYTSTRADLAGVDHTDQGPSLGAGPSNDPVSVPEARSQTRTSVSAHLQLEELNGQPYEVYGEQPAPLGTPDFCCRLMGELVRLPSTSPAAQSRFRDAFFDTYGALFAPAVGSTTFTVNNSSTSDFANGQPFEFLPIGVEIGNSAQYDEFALPSYNGAIGENRHLAPVAAPGFPGENIVFFSSNLPVWDSTSAQNNRRISCLLPNEFVQHFYDLQAPSQSDVALLRYVHPESGRVLFECKLYRDGFLTVNGASLAEFPVNGYFRFDSWVNQFFTLSPVGTGSGRSGRSRNAQ

SEQ ID NO: 2023 - protein, 540 aa, Artificial Sequence; identical to SEQ ID NO: 1169
  major_capsid_protein__Norovirus__ACW19927

SEQ ID NO: 2024 - protein, 540 aa, Artificial Sequence
  major_capsid_protein__Norovirus__ACX31885
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2025 - protein, 540 aa, Artificial Sequence
  major_capsid_protein__Norovirus__ACX31887
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPNYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRRAL

SEQ ID NO: 2026 - protein, 540 aa, Artificial Sequence
  major_capsid_protein__Norovirus__ACX31891
MKMASSDASPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHITGSRNYTMNLASQNWNNYDPTEEIPAPLGTPDFVGKIQGMLTQTTRGDGSTRGHKATVYTGSADFAPKLGRVQFATDTDNDFESNQNTKFTPVGVIQDGNTTHQNEPQQWVLPGYSGRDGHNVHLAPAVAPTYPGEQLLFFRSTMPGCSGYPNMNLDCLLPQEWVQHFYQEAAPAQSEVALLRFVNPDTGRVLFECKLHKSGYVTVAHTGQHDLVIPPNGYFRFDSWVNQFYTLAPMGNGAGRRRAL

SEQ ID NO: 2027 - protein, 540 aa, Artificial Sequence
  major_capsid_protein__Norovirus__ACZ37232
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNTNEPNPATRAHEANINTGGDQYAPKLAQVKFFSESQDFEVHQPTVFTPVGVAGDTSHPFRQWVLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRIQ

SEQ ID NO: 2028 - protein, 540 aa, Artificial Sequence; identical to SEQ ID NO: 22
  major_capsid_protein__Norovirus__ADD10375

SEQ ID NO: 2029 - protein, 540 aa, Artificial Sequence
  major_capsid_protein__Norovirus__ADO85552
MKMASSDANPSDGSTANLVPEVNNEVMALEPVVGAASAAPVAGQQNVIDPWIRNNFVQAPGGEFTESPTNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPATVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPVGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2030 - protein, 540 aa, Artificial Sequence
  major_capsid_protein__Norovirus__ADQ43779
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWALPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2031 - protein, 540 aa, Artificial Sequence; identical to SEQ ID NO: 62
  major_capsid_protein__Norovirus__ADQ43781

SEQ ID NO: 2032 - protein, 540 aa, Artificial Sequence; identical to SEQ ID NO: 562
  major_capsid_protein__Norovirus__ADQ43783

SEQ ID NO: 2033 - protein, 540 aa, Artificial Sequence; identical to SEQ ID NO: 562
  major_capsid_protein__Norovirus__ADV37805

SEQ ID NO: 2034 - protein, 540 aa, Artificial Sequence; identical to SEQ ID NO: 562
  major_capsid_protein__Norovirus__ADV37807

SEQ ID NO: 2035 - protein, 540 aa, Artificial Sequence; identical to SEQ ID NO: 562
  major_capsid_protein__Norovirus__ADV37809

SEQ ID NO: 2036 - protein, 540 aa, Artificial Sequence
  major_capsid_protein__Norovirus__ADV37813
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDLETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2037 - protein, 540 aa, Artificial Sequence
  major_capsid_protein__Norovirus__ADV37917
MKMASSDTKTSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2038 - protein, 540 aa, Artificial Sequence
  major_capsid_protein__Norovirus__ADV37919
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2039 - protein, 535 aa, Artificial Sequence
  major_capsid_protein__Norovirus__AEI83469
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEEDDVHINQPTKFTPVGLFESEGFNQWTLPNYSGALTLNMGLAPPVAPTFPGEQILFFRSHISLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQ

SEQ ID NO: 2040 - protein, 547 aa, Artificial Sequence
  major_capsid_protein__Norovirus__AEP04093
MKMASNDAAPSTDGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTIGDGQPASHSEEEIMPMAFNIQRELMLENLDGSPYDPTDDIPAVLGSPDFQGVIFGILSQRNGDGQTRAHEAKVDTRAARFAPKLGFVVATVESTDFHANQPSRFTPVGLGGDGNQDFAQWNLPTYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRTR

SEQ ID NO: 2041 - protein, 539 aa, Artificial Sequence
  major_capsid_protein__Norovirus__AEQ77282
MMMASKDAPSNMDGTSGAGQLVPEVNAAEPLPLEPVVGAATAAATAGQVNLIDPWIMNNFVQAPEGEFTISPNNTPGDILFDLHLGPHLNPFLQHLSQMYNGWVGNMRVRVMLAGNAFTAGKIIICCVPPGFASQNISIGQATMFPHVIADVRVLEPIEIPLDDVRNVLFHTNENRPTMRLLCMLYTPLRAGGASSGTDPFVIAGRVLTCPSPDFNFLFLVPPSVEQKTRQLTVPNIPLNNLANSRVPAMINKMTVSTDQNQVVQFQNGRCTLEGQLLGTTPVSASQVARIRGKVFSTASGKGLNLTELDGTPYHAFESPAPLGFPDIGACDWHVSTFKVDQNLSGDPMSRLDVKQNAPFAPHLGSIEFTSDQDPTGDQLGTLAWVSPSTSGARVDPWKIPSYGSTVTESTHLAPPIFPPGFGEAIVYFMSDFPIVSGNTAQVPCTLPQEFVSHFVEQQAPVRGEAALLHYVDPDTHRNLGEFKLYPDGFITCVPNTGGGPQNLPTNGVFVFSSWVSRYYQLKPVGTAGPARRLGVRRV

SEQ ID NO: 2042 - protein, 535 aa, Artificial Sequence
  major_capsid_protein__Norovirus__AFA55174
MKMASNDAAPSNDGAAGLVPEVNNETMALEPVAGASIAAPLTGQNNVIDPWIRMNFVQAPNGEFTVSPRNSPGEVLLNLELGPELNPFLAHLSRMYNGYAGGVEVQVLLAGNAFTAGKLVFAAIPPHFPLENLSPGQITMFPHVIIDVRTLEPVLLPLPDVRNNFFHYNQQPEPRMRLVAMLYTPLRSNGSGDDVFTVSCRVLTRPSPDFDFNYLVPPTVESKTKPFTLPILTIGELSNSRFPVPIDELYTSPNEGVVVQPQNGRSTLDGELLGTTQLVPSNICALRGRINAQVPDDHHQWNLQVTNANGTSFDPTEDVPAPLGTPDFLANIYGVTSQRNPDNTCRAHDGVLATWSPKFTPKLGSVVLGTWEESDLDLNQPTRFTPVGLYDTGHFDQWVLPNYSGRLTLNMNLAPSVAPLFPGEQILFFRSHIPLKGGTSNGAIDCLLPQEWIQHFYQESAPSPTDVALIRYTNPDTGRVLFEAKLHRQGFITVANSGSRPIVVPPNGYFRFDSWVNQFYSLAPMGTGNGRRRVQ

SEQ ID NO: 2043 - protein, 542 aa, Artificial Sequence
  major_capsid_protein__Norovirus__AFC89656
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPISIEQLYTAPNENNVVQCQNGRCTLDGELQGTTQLLSSAVCSYRGRTVANSGDNWDQNVLQLTYPSGASYDPTDEVPAPLGTQDFSGILYGVLTQDNVRENTGEAKNAKGVYISTTSGKFTPKIGSIGLHSITEDVRPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRVQ

SEQ ID NO: 2044 - protein, 538 aa, Artificial Sequence
  major_capsid_protein__Norovirus__AFC89659
MMMASKDAPSNMDGTSGAGQLVPEVNTAEPLPLEPVVGAATAAATAGQVNLIDPWIMNNFVQAPEGEFTISPNNTPGDILFDLRLGPHLNPFLLHLSQMYNGWVGNMRIRVMLAGNAFSAGKIIICCVPPGFESQNISIGQATMFPHVIADVRVLEPIEIPLDDVRNVLYHTNENRPTMRLLCMLYTPLRAGGASSGTDPFVIAGRVLTCPAPDFNFLFLVPPSVEQKTRQLTIPNIPLNNLANSRVPAMINKMAVSADQNQVVQFQNGRCTLEGQLLGTTPVSANQVARIRGKVFSTNSGTGLNLTETDGTPYHAFESPAPLGFPDIGDCDWHVYAFKVNQNTGDPMYRLDITQGNSFAPHLGSIEFTSDQHPSGDQLGTLTWISPLNNASRVDPWKIPSYGSTLTESTNLAPPIFPPGFGEAIVYFMSDFPIVSGNTTQIPCTLPQEFISSFVEQQAPIRGEAALLHYVDPDTHRNLGEFKLYPDGFITCVPNTGGGPQNLPSNGVFIFSSWVSRYYQLKPVGTAGPARRLGVRRI

SEQ ID NO: 2045 - protein, 548 aa, Artificial Sequence
  major_capsid_protein__Norovirus__AFC89662
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPTDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKIFGVASQRNPDSTTRAHEAKVDTTAGRFTPKLGSLEISTESGDFDQNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2046 - protein, 539 aa, Artificial Sequence
  major_capsid_protein__Norovirus__AFC89665
MKMASNDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGMTSNPTSDYWDDHLLHLVHPNGATYDPTEDVPAPFGTQDFRGILYGMLTQNPRTSGDEAANSHGIYISSTSEKFTPKLGTIGLHQVQGDIASNQQSKFTPVGIAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRVQ

SEQ ID NO: 2047 - protein, 540 aa, Artificial Sequence; identical to SEQ ID NO: 472
  major_capsid_protein__Norovirus__AFC89667

SEQ ID NO: 2048 - protein, 541 aa, Artificial Sequence
  major_capsid_protein__Norovirus__AFD62272
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGTGQVATFTMIEQDGSAYVPGDRAAPLGYPDYSGQLEIEVQTETTKAGDKLKVTTFEMILGPTTNVDQAPYQGRAYASLTAAASLDLVDGRVRAVPRSIYSFQDVLPEYNDGLLVPLAPPLGPFLPGEVLLRFRTYMRQLDTADAAAQPIDCALPQEFVSWFASNSFTVQSDALLVRYRNTLTGQLLFEAKLYSEGYIAVSYSGSGPLTFPADGFFEVVSWVPRLFQLASVGSLATGRTLKQ

SEQ ID NO: 2049 - protein, 539 aa, Artificial Sequence
  major_capsid_protein__Norovirus__AFJ04707
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDITHIAGSHDYTMNLASQNWSNYDPTEEIPAPLGTPDFVGKIQGMLTQTTREDGSTRAHKATVSTGSVHFTPKLGSVQYTTDTNNDFQTGQNTKFTPVGVIQDGGNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRAL

SEQ ID NO: 2050 - protein, 540 aa, Artificial Sequence
  major_capsid_protein__Norovirus__AFJ04708
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2051 - protein, 540 aa, Artificial Sequence
  major_capsid_protein__Norovirus__AFJ04709
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGGRRAL

SEQ ID NO: 2052 - protein, 540 aa, Artificial Sequence
  major_capsid_protein__Norovirus__AFP89593
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVIQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRVL

SEQ ID NO: 2053 - protein, 540 aa, Artificial Sequence
  major_capsid_protein__Norovirus__AFU55686
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFEAGQNTKFTPDGVVQDGNGTHQNEPQQWVLPSYSGRTGHNVHLAPAIAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2054 - protein, 540 aa, Artificial Sequence
  major_capsid_protein__Norovirus__AFU55689
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGAPDFVGKIQGVLTQTTRGDGSTRGHKATVSTGSVHFTPKLGSVQFSTDTSNDLETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 2055 - protein, 540 aa, Artificial Sequence
  major_capsid_protein__Norovirus__AFU55692
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKPGYVTVAHTGQHDLVIPPNGYFRFDSWVNQFYTLAPMGNGAGRRRAL

SEQ ID NO: 2056 - protein, 540 aa, Artificial Sequence; identical to SEQ ID NO: 485
  major_capsid_protein__Norovirus__AFU55695

SEQ ID NO: 2057 - protein, 540 aa, Artificial Sequence
  major_capsid_protein__Norovirus__AFU55698
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLGANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2058 - protein, 540 aa, Artificial Sequence; identical to SEQ ID NO: 1035
  major_capsid_protein__Norovirus__AFU55701

SEQ ID NO: 2059 - protein, 540 aa, Artificial Sequence; identical to SEQ ID NO: 1124
  major_capsid_protein__Norovirus__AFU55704

SEQ ID NO: 2060 - protein, 540 aa, Artificial Sequence
  major_capsid_protein__Norovirus__AFU55707
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTEGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2061 - protein, 540 aa, Artificial Sequence; identical to SEQ ID NO: 531
  major_capsid_protein__Norovirus__AFU55710

SEQ ID NO: 2062 - protein, 540 aa, Artificial Sequence
  major_capsid_protein__Norovirus__AFU55713
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2063 - protein, 540 aa, Artificial Sequence
  major_capsid_protein__Norovirus__AFU55716
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLIIPPNGYFRFDSWVNQFYTLAPMGNGTGRRRAL

SEQ ID NO: 2064 - protein, 540 aa, Artificial Sequence; identical to SEQ ID NO: 1107
  major_capsid_protein__Norovirus__AFU55719

SEQ ID NO: 2065 - protein, 540 aa, Artificial Sequence; identical to SEQ ID NO: 22
  major_capsid_protein__Norovirus__AFU55722

SEQ ID NO: 2066 - protein, 540 aa, Artificial Sequence
  major_capsid_protein__Norovirus__AFU55725
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSAEFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2067 - protein, 540 aa, Artificial Sequence
  major_capsid_protein__Norovirus__AFU55728
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2068 - protein, 540 aa, Artificial Sequence
  major_capsid_protein__Norovirus__AFU55731
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEVPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2069 - protein, 540 aa, Artificial Sequence; identical to SEQ ID NO: 62
  major_capsid_protein__Norovirus__AFU55734

SEQ ID NO: 2070 - protein, 540 aa, Artificial Sequence; identical to SEQ ID NO: 62
  major_capsid_protein__Norovirus__AFU55737

SEQ ID NO: 2071 - protein, 540 aa, Artificial Sequence
  major_capsid_protein__Norovirus__AFU92659
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIPMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQSYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 2072 - protein, 540 aa, Artificial Sequence
  major_capsid_protein__Norovirus__AFU92660
MKMASNDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2073 - protein, 540 aa, Artificial Sequence
  major_capsid_protein__Norovirus__AFU92661
MKMASNDATPSDGSTANLVPEVNNEVMALEPVVGAAIAAPVAGQQNVIDPWIRNNFVQAPGGEFTVSPRNAPGEILCHAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATLSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 2074 - protein, 540 aa, Artificial Sequence
  major_capsid_protein__Norovirus__AFU92662
MKMASNDATPSDGSTANLVPEVNNEVMALEPVVGAAIAAPVAGQQNVIDPWIRNNFVQAPGGEFTVSPRNAPGEILWHAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 2075 - protein, 540 aa, Artificial Sequence
  major_capsid_protein__Norovirus__AFU92663
MKMASNDATPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTNIAGSQTYTMNLASQNWNNYDPTEEIPAPLGTPDFVGRIQGVLTQTTRGDGSTRGHKATVSTGSAYFTPKLGSVQFSTDTSTDFETGQNTRFTPVGVVQDGSTTHKNEPQQWVLPSYSGRDSHNVHLAPAVAPTFPGEQILFFRSTMPGCSGYPNMDLDCLLPQEWVQHFYQESAPAQSDVALLRFVNPDTGRVLFECKLHKSGYVTVAHTGQHDLVIPPNGYFRFDSWVNQFYTLAPMGNGAGRRRAL

SEQ ID NO: 2076 - protein, 540 aa, Artificial Sequence
  major_capsid_protein__Norovirus__AFU92664
MKMASNDANPSDGSAAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2077 - protein, 540 aa, Artificial Sequence
  major_capsid_protein__Norovirus__AFU92666
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSLDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2078 - protein, 540 aa, Artificial Sequence
  major_capsid_protein__Norovirus__AFU92667
MKMASNDATPSDGVAAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2079 - protein, 540 aa, Artificial Sequence
  major_capsid_protein__Norovirus__AFU92668
MKMASNDVTPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2080 - protein, 540 aa, Artificial Sequence; identical to SEQ ID NO: 1090
  major_capsid_protein__Norovirus__AFU92669

SEQ ID NO: 2081 - protein, 540 aa, Artificial Sequence
  major_capsid_protein__Norovirus__AFU92670
MKMASNDANPSDGSAANLVPEVNNEVMALEPVVGAAIAAPVAGQQNVIDPWIRNNFVQAPGGEFTVSPRNAPGEILWRAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2082 - protein, 540 aa, Artificial Sequence
  major_capsid_protein__Norovirus__AFU92671
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2083 - protein, 540 aa, Artificial Sequence
  major_capsid_protein__Norovirus__AFU92672
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2084 - protein, 540 aa, Artificial Sequence
  major_capsid_protein__Norovirus__AFU92673
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFAVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYATVAHTGQHDLVIPPNGYFRFDSWVNQFYTLAPMGNGTGRRRAL

SEQ ID NO: 2085 - protein, 540 aa, Artificial Sequence
  major_capsid_protein__Norovirus__AFU92674
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWTNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2086 - protein, 540 aa, Artificial Sequence
  major_capsid_protein__Norovirus__AFU92676
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTSRDGSTRGHKATVSTGSVHFTPKLGRVQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2087 - protein, 540 aa, Artificial Sequence
  major_capsid_protein__Norovirus__AFU92677
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2088 - protein, 540 aa, Artificial Sequence
  major_capsid_protein__Norovirus__AFU92678
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQYDVALLRFVNPDTGRVLFECKLHKSGYVTVAHTGQHDLVIPPNGYFRFDSWVNQFYTLAPMGNGTGRRRAL

SEQ ID NO: 2089 - protein, 540 aa, Artificial Sequence
  major_capsid_protein__Norovirus__AFU92679
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPEFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2090 - protein, 540 aa, Artificial Sequence; identical to SEQ ID NO: 1090
  major_capsid_protein__Norovirus__AFU92680

SEQ ID NO: 2091 - protein, 540 aa, Artificial Sequence; identical to SEQ ID NO: 485
  major_capsid_protein__Norovirus__AFU92681

SEQ ID NO: 2092 - protein, 540 aa, Artificial Sequence; identical to SEQ ID NO: 485
  major_capsid_protein__Norovirus__AFU92682

SEQ ID NO: 2093 - protein, 540 aa, Artificial Sequence; identical to SEQ ID NO: 1169
  major_capsid_protein__Norovirus__AFU92684

SEQ ID NO: 2094 - protein, 540 aa, Artificial Sequence
  major_capsid_protein__Norovirus__AFU92685
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVAHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2095 - protein, 540 aa, Artificial Sequence
  major_capsid_protein__Norovirus__AFU92686
MKMASNDAHPSDGSAATLVPKVNNEVMALEPVVGAAIAAPVAGQQNVIDPWIRNNFVQAPGGEFTVSPRNAPGEILWSAPLGPDLNPYLSHLARMYNGYAGGFELHVLLAGNAFTAGKIIIAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICIFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2096 - protein, 540 aa, Artificial Sequence
  major_capsid_protein__Norovirus__AFU92687
MKMASNDPNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 2097 - protein, 540 aa, Artificial Sequence
  major_capsid_protein__Norovirus__AFU92688
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGPPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRRAL

SEQ ID NO: 2098 - protein, 540 aa, Artificial Sequence; identical to SEQ ID NO: 512
  major_capsid_protein__Norovirus__AFU92689

SEQ ID NO: 2099 - protein, 540 aa, Artificial Sequence; identical to SEQ ID NO: 512
  major_capsid_protein__Norovirus__AFU92690

SEQ ID NO: 2100 - protein, 540 aa, Artificial Sequence; identical to SEQ ID NO: 512
  major_capsid_protein__Norovirus__AFU92691

SEQ ID NO: 2101 - protein, 540 aa, Artificial Sequence; identical to SEQ ID NO: 1169
  major_capsid_protein__Norovirus__AFU92692

SEQ ID NO: 2102 - protein, 540 aa, Artificial Sequence
  major_capsid_protein__Norovirus__AFU92693
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2103 - protein, 540 aa, Artificial Sequence; identical to SEQ ID NO: 562
  major_capsid_protein__Norovirus__AFU92694

SEQ ID NO: 2104 - protein, 540 aa, Artificial Sequence; identical to SEQ ID NO: 621
  major_capsid_protein__Norovirus__AFU92695

SEQ ID NO: 2105 - protein, 540 aa, Artificial Sequence; identical to SEQ ID NO: 1147
  major_capsid_protein__Norovirus__AFU92696

SEQ ID NO: 2106 - protein, 540 aa, Artificial Sequence; identical to SEQ ID NO: 621
  major_capsid_protein__Norovirus__AFU92697

SEQ ID NO: 2107 - protein, 540 aa, Artificial Sequence; identical to SEQ ID NO: 472
  major_capsid_protein__Norovirus__AFU92698

SEQ ID NO: 2108 - protein, 540 aa, Artificial Sequence
  major_capsid_protein__Norovirus__AFU92699
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIILDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTRRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2109 - protein, 540 aa, Artificial Sequence
  major_capsid_protein__Norovirus__AFU92700
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2110 - protein, 540 aa, Artificial Sequence; identical to SEQ ID NO: 621
  major_capsid_protein__Norovirus__AFU92701

SEQ ID NO: 2111 - protein, 540 aa, Artificial Sequence; identical to SEQ ID NO: 562
  major_capsid_protein__Norovirus__AFU92702

SEQ ID NO: 2112 - protein, 540 aa, Artificial Sequence
  major_capsid_protein__Norovirus__AFU92703
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2113 - protein, 540 aa, Artificial Sequence
  major_capsid_protein__Norovirus__AFU92704
MKMASSDANPSDGSTAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2114 - protein, 540 aa, Artificial Sequence; identical to SEQ ID NO: 472
  major_capsid_protein__Norovirus__AFU92705

SEQ ID NO: 2115 - protein, 540 aa, Artificial Sequence; identical to SEQ ID NO: 62
  major_capsid_protein__Norovirus__AFU92706

SEQ ID NO: 2116 - protein, 540 aa, Artificial Sequence
  major_capsid_protein__Norovirus__AFU92707
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVEFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2117 - protein, 540 aa, Artificial Sequence
  major_capsid_protein__Norovirus__AFU92708
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMNLDCLIPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 2118 - protein, 540 aa, Artificial Sequence; identical to SEQ ID NO: 62
  major_capsid_protein__Norovirus__AFU92709

SEQ ID NO: 2119 - protein, 540 aa, Artificial Sequence; identical to SEQ ID NO: 62
  major_capsid_protein__Norovirus__AFU92710

SEQ ID NO: 2120 - protein, 540 aa, Artificial Sequence; identical to SEQ ID NO: 62
  major_capsid_protein__Norovirus__AFU92711

SEQ ID NO: 2121 - protein, 540 aa, Artificial Sequence
  major_capsid_protein__Norovirus__AFU92712
MKMASNDANPSEGSAANLVPEVNNEVMALEPVVGAAIAAPVAGQQNVIDPWIRNNFVQAPGGEFTVSPRNAPGTIRWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFSIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFESHQNTKFTPVGVIQDGSTTHRNEPQQWVLPSYSGRNVHNVHLAPAVAPTFPGEQLLFFRSTMPGCSGYPNMDLDCLIPQEWVQHFYQEAAPAQSDVALLRFVNPDTGRVLFECKLHKSGYVTVAHTGQHDLVIPPNGYFRFDSWVNQFYTLAPMGNGAGRRRAL

SEQ ID NO: 2122 - protein, 540 aa, Artificial Sequence
  major_capsid_protein__Norovirus__AFU92713
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFSIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2123 - protein, 540 aa, Artificial Sequence; identical to SEQ ID NO: 62
  major_capsid_protein__Norovirus__AFU92714

SEQ ID NO: 2124 - protein, 540 aa, Artificial Sequence
  major_capsid_protein__Norovirus__AFU92715
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFSIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2125 - protein, 540 aa, Artificial Sequence
  major_capsid_protein__Norovirus__AFU92717
MKMASSDPNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSKLKLRPMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2126 - protein, 540 aa, Artificial Sequence
  major_capsid_protein__Norovirus__AFU92718
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSLDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2127 - protein, 540 aa, Artificial Sequence; identical to SEQ ID NO: 621
  major_capsid_protein__Norovirus__AFU92719

SEQ ID NO: 2128 - protein, 540 aa, Artificial Sequence
  major_capsid_protein__Norovirus__AFU92720
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2129 - protein, 540 aa, Artificial Sequence
  major_capsid_protein__Norovirus__AFU92721
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2130 - protein, 540 aa, Artificial Sequence
  major_capsid_protein__Norovirus__AFU92722
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFIVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2131 - protein, 540 aa, Artificial Sequence
  major_capsid_protein__Norovirus__AFU92723
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2132 - protein, 548 aa, Artificial Sequence
  major_capsid_protein__Norovirus__AGD79474
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDREADFQQWSLPDYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 2133 - protein, 548 aa, Artificial Sequence
  major_capsid_protein__Norovirus__AGD79475
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVILPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTVTPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDREADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2134 - protein, 548 aa, Artificial Sequence
  major_capsid_protein__Norovirus__AGD79476
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDTTTRAHEAKVDTTSGRFTPKLGSLEISTESDDFDQNKPTRFTPVGIGVDHEADFQQWTLPDYAGQFTHNMNLAPAVVPNFPGEQLLFFRSQLPSSGGRSNGILDCLVPQEWVQHFYQESAPSQSQVALVRYINPDTGRVLFEAKLHKLGFMTIAKNGDSPITVPPNGYFRFESWVNPFYTLAPMGTGNGRRRIQ

SEQ ID NO: 2135 - protein, 548 aa, Artificial Sequence
  major_capsid_protein__Norovirus__AGD79477
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDTSTRAHEAKIDTTSGRFTPKLGSLEISTESDDFDQNKPTRFTPVGIGVDHETDFQQWTLPDYAGQLTHNMNLAPAVAPNFPGEQLLFFRSQLPSSGGRSNGILDCLVPQEWVQHFYQESAPSQSQVALVRYINPDTGRVLFEAKLHKLGFMTIAKNGDSPITVPPNGYFRFESWVNPFYTLAPMGTGNGRRRIQ

SEQ ID NO: 2136 - protein, 548 aa, Artificial Sequence
  major_capsid_protein__Norovirus__AGD79478
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNETPYDPAEGIPGPLGTPDFRGKVFGVASQRNPDTTTRAHEAKVDTTSGRFTPKLGSLEISTESDDFDQNKPTRFTPVGIGVDHEADFQQWTLPDYAGQFTHNMNLAPAVAPNFPGEQLLFFRSQLPSSGGRSNGILDCLVPQEWVQHFYQESAPSQSQVALVRYINPDTGRVLFEAKLHKLGFITIAKNGDSPITVPPNGYFRFESWVNPFYTLAPMGTGNGRRRIQ

SEQ ID NO: 2137 - protein, 548 aa, Artificial Sequence
  major_capsid_protein__Norovirus__AGD79479
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDTTTRAHEAKVDTTSGRFTPKLGSLEISTESDDFDQNKPTRFTPVGIGVDHEADFQQWTLPDYAGQFTHNMNLAPAVAPNFPGEQLLFFRSQLPSSGGRTNGILDCLVPQEWVQHFYQESAPSQSQVALVRYINPDTGRVLFEAKLHKLGFITIAKNGDSPITVPPNGYFRFESWVNPFYTLAPMGTGNGRRRIQ

SEQ ID NO: 2138 - protein, 539 aa, Artificial Sequence
  major_capsid_protein__Norovirus__AGH24750
MKMASNDTIPSDGSTANLVPEVNNEVMALEPVVGAAIAAPVAGQQNVIDPWIRNNFVQAPGGEFTVSPRNAPGEILWSMPLSPDLNPYLSHLSRMYNGYAGGFEVQVILAGNAFTAGKIIFAAIPPNFPTDGLSPSQVTMFPHIIVDVRQLEPVLIPLPDVRNNFYHYNQVNDSTLKLIAMLYTPLRANNAGDDVFTVSCRVLTRPSPDFDFIFLVPPTVESRTKPFTVPILTVDEMTNSRFPTPLERLHTGPNNSLVVQPQNGRCTIDGVLLGTTQLSAVNICSFRGDSTTREGQSHAYTMNLASQNWTNYDPTEDIPAPLGTPDFVGKIVGMLSQTTRENSSTRAHKATVSTGDAHFMPKLGSVLFTTDTEDLQNGQNTRFTPVGVAQDGEPHQNEPQQWRLPNYSGTPGHNVHLAPPVAPTFPGEQLLFFRSTMPGCGGYPNMDLDCLLPQEWVRHFYQEAAPAQSDVALLRFVNPDTGRVLFECKLHKAGYITVSHTGPYDLVIPPNGYFRFDSWVNQFYALAPMGTGTGRRRAL

SEQ ID NO: 2139 - protein, 540 aa, Artificial Sequence; identical to SEQ ID NO: 562
  major_capsid_protein__Norovirus__AGI37922

SEQ ID NO: 2140 - protein, 540 aa, Artificial Sequence
  major_capsid_protein__Norovirus__AGM46344
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2141 - protein, 540 aa, Artificial Sequence
  major_capsid_protein__Norovirus__AGM46347
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2142 - protein, 540 aa, Artificial Sequence; identical to SEQ ID NO: 62
  major_capsid_protein__Norovirus__AGM46349

SEQ ID NO: 2143 - protein, 540 aa, Artificial Sequence; identical to SEQ ID NO: 62
  major_capsid_protein__Norovirus__AGM46355

SEQ ID NO: 2144 - protein, 540 aa, Artificial Sequence
  major_capsid_protein__Norovirus__AGM46359
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISSSRNYTMNLASQNWSSYDPTEEIPAPLGTPDFVGKIQGVLTQTTRTDGSTRGHKATVYTGSADFSPKLGRVQFDTDTDNDFETNQNTKFTPVGVIQDGSTTYRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2145 - protein, 540 aa, Artificial Sequence
  major_capsid_protein__Norovirus__AGM46362
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISSSRNYTMNLASQNWSSYDPTEEIPAPLGTPDFVGKIQGVLTQTTRTDGSTRGHKATVYTGSADFSPKLGRVQFDTDTDNDFETNQNTKFTPVGVIQDGSTTYRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2146 - protein, 540 aa, Artificial Sequence
  major_capsid_protein__Norovirus__AGM46366
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGSRRAL

SEQ ID NO: 2147 - protein, 540 aa, Artificial Sequence; identical to SEQ ID NO: 62
  major_capsid_protein__Norovirus__AGM46367

SEQ ID NO: 2148 - protein, 540 aa, Artificial Sequence
  major_capsid_protein__Norovirus__AGM46370
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2149 - protein, 540 aa, Artificial Sequence; identical to SEQ ID NO: 2148
  major_capsid_protein__Norovirus__AGM46375

SEQ ID NO: 2150 - protein, 540 aa, Artificial Sequence
  major_capsid_protein__Norovirus__AGM46377
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2151 - protein, 540 aa, Artificial Sequence; identical to SEQ ID NO: 2148
  major_capsid_protein__Norovirus__AGM46379

SEQ ID NO: 2152 - protein, 540 aa, Artificial Sequence; identical to SEQ ID NO: 2148
  major_capsid_protein__Norovirus__AGM46384

SEQ ID NO: 2153 - protein, 540 aa, Artificial Sequence
  major_capsid_protein__Norovirus__AGM46386
MKMGSNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2154 - protein, 540 aa, Artificial Sequence
  major_capsid_protein__Norovirus__AGM46388
MKMGSNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2155 - protein, 540 aa, Artificial Sequence
  major_capsid_protein__Norovirus__AGM46392
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQFLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2156 - protein, 540 aa, Artificial Sequence; identical to SEQ ID NO: 562
  major_capsid_protein__Norovirus__AGM46395

SEQ ID NO: 2157 - protein, 540 aa, Artificial Sequence
  major_capsid_protein__Norovirus__AGM46398
MKMASSDANPSDGSKANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGSRRAL

SEQ ID NO: 2158 - protein, 540 aa, Artificial Sequence; identical to SEQ ID NO: 62
  major_capsid_protein__Norovirus__AGM46401

SEQ ID NO: 2159 - protein, 540 aa, Artificial Sequence; identical to SEQ ID NO: 62
  major_capsid_protein__Norovirus__AGM46403

SEQ ID NO: 2160 - protein, 540 aa, Artificial Sequence
  major_capsid_protein__Norovirus__AGM46407
MKMASSDANPSDGSTANLVPEVNNEVMALEPVVGAAIAAPVAGQQNVIDPWIRNNFVQAPGGEFTVSPRNAPGEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2161 - protein, 540 aa, Artificial Sequence
  major_capsid_protein__Norovirus__AGM46409
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2162 - protein, 540 aa, Artificial Sequence; identical to SEQ ID NO: 1182
  major_capsid_protein__Norovirus__AGM46413

SEQ ID NO: 2163 - protein, 540 aa, Artificial Sequence
  major_capsid_protein__Norovirus__AGM46415
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2164 - protein, 540 aa, Artificial Sequence
  major_capsid_protein__Norovirus__AGM46419
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGIPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2165 - protein, 540 aa, Artificial Sequence
  major_capsid_protein__Norovirus__AGM46421
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2166 - protein, 540 aa, Artificial Sequence
  major_capsid_protein__Norovirus__AGM46425
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRVYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRNAPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2167 - protein, 540 aa, Artificial Sequence
  major_capsid_protein__Norovirus__AGM46427
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLPPVNICTFRGDVTHIAGSRVYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRNAPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2168 - protein, 540 aa, Artificial Sequence; identical to SEQ ID NO: 1286
  major_capsid_protein__Norovirus__AGM46431

SEQ ID NO: 2169 - protein, 556 aa, Artificial Sequence
  major_capsid_protein__Norovirus__AGN11430
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEVVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASPEADERAVGSFDVWVRLQEPDGQPYDIFGKQPAPIGTPDFKAVIVGFAARPLTSGSYANEAYVNTTASNYAPATGNMRFTVRNGGTGHTSANKYWEFKSFGVEGERHTGIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRRGRVRFQ

SEQ ID NO: 2170 - protein, 548 aa, Artificial Sequence
  major_capsid_protein__Norovirus__AGO64038
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDPKLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRTSDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2171 - protein, 540 aa, Artificial Sequence
  major_capsid_protein__Norovirus__AGO64040
MKMASNDAAPSNDGAAGLVPEINNEVMPLEPVAGASPATPVVGQQNIIDPWIRNNFVQAPAGEFTVSPRNSPGEILLDLELGPELNPYLAHLARMYNGHAGGMEVQIVLAGNAFTAGKIIFAAIPPGFPHENLSPSQITMCPHVIIDVRQLEPVLLPMPDIRNNFFHYNQGNDPKLRLIAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLGIDICKFKGEVIAKNRDDRSYRMDMEITNTDGTPIDPTEDTPGPIGSPDFRGILFGVASQRNKNEQNPATRGHEANINTGGNQYAPKLAQVKFFSESDDFDEHQPTVFTPVGVAGDDSHPFRQWVLPRYGGHLTNNTHLAPAVAPLFPGEQILFFRSQIPSSGGFELGYMDCLVPQEWVQHFYQEAATAQSDVALIRFINPDTGRVLFEAKLHKQGFITVAHTGDNPIVMPPNGYFRFEAWVNQFYSLAPVGTGNGRRRVQ

SEQ ID NO: 2172 - protein, 535 aa, Artificial Sequence
  major_capsid_protein__Norovirus__AGO64042
MKMASNDAAPSNDGAAGLVPEANNETMALEPVAGASIAAPLTGQNNVIDPWIRLNFVQAPNGEFTVSPRNSPGEILLNLELGPELNPYLAHLSRMYNGYAGGVEVQVLLAGNAFTAGKLVFAAVPPHFPLENISPGQITMFPHVIIDVRTLEPVLLPLPDVRNSFFHYNQQNEPRMRLVAMLYTPLRSNGSGDDVFTVSCRVLTRPSPDFDFNYLVPPTVESKTKPFTLPILTMGELTNSRFPVPIDELYTSPNENLVVQPQNGRCALDGELQGTTQLLPTAICSFRGRVNQKVSGENHVWNMQVTNINGTPFDPTEDVPAPLGTPDFSGRLFGVLSQRDHDNACRSHDAVIATNSTKFTPKLGAIQIGTWEEDDVHINQPTKFTPVGLFDTDDFNQWALPNYSGALTLNMGLAPPVAPTFPGEQILFFRSHIPLKGGVADPVIDCLLPQEWIQHLYQESAPSQSDVALIRFTNPDTGRVLFEAKLHRSGYITVANTGNRPIVVPANGYFRFDSWVNQFYSLAPMGTGNGRRRVQ

SEQ ID NO: 2173 - protein, 540 aa, Artificial Sequence
  major_capsid_protein__Norovirus__AGS41450
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVLPSYSGRNVHNVHLAPAVAPNFPGEQLLFFRSTMPGCSGYPNTDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2174 - protein, 540 aa, Artificial Sequence
  major_capsid_protein__Norovirus__AGT62521
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFMSPDVNQSVQFQNGRCQIDGQLQGTTPVSLSQLCKIRGKTSSNARVLNLSEVDGTPFIPLESPAPVGFPDLGGCDWHVNFTFQAQDQDPSQSVTFATNDASFVPYLGSISPHNGGDFHAGDIIGSLGWISAPSGNSQLNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 2175 - protein, 542 aa, Artificial Sequence
  major_capsid_protein__Norovirus__AGT62523
MKMASNDAAPSTDGAAGLVPESNNEVMALEPVAGAALAAPVTGQTNIIDPWIRTNFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGEMSNSRFPVPIDQMYTSPNEVISVQCQNGRCTLDGELQGTTQLQVSGICAFKGQVTAHLQDNEHLYNVTITNLNGSPFDPSEDIPAPLGVPDFEGRVFGVISQRDNYNSGGQNQPANRSHDAVVPTYTAQYTPKLGQIQIGTWQTDDITVDQPAKFTPVGLSDTDHFNQWVVPRYAGALNLNTNLAPSVAPVFPGERLLFFRSYIPLKGGFGNPAIDCLVPQEWIQHFYQEAAPSLSEVALVRYINPDTGRALFEAKLHRAGFMTVSSNTSAPVVVPANGYFRFDSWVNQFYSLAPMGTGNGRRRIQ

SEQ ID NO: 2176 - protein, 540 aa, Artificial Sequence; identical to SEQ ID NO: 1380
  major_capsid_protein__Norovirus__AGV40221

SEQ ID NO: 2177 - protein, 540 aa, Artificial Sequence
  major_capsid_protein__Norovirus__AGV76553
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHSGQHDLVIPPNGYFRFDSWVNQFYTLAPMGNGTGRRRAL

SEQ ID NO: 2178 - protein, 540 aa, Artificial Sequence; identical to SEQ ID NO: 681
  major_capsid_protein__Norovirus__AGV76554

SEQ ID NO: 2179 - protein, 540 aa, Artificial Sequence; identical to SEQ ID NO: 681
  major_capsid_protein__Norovirus__AGV76555

SEQ ID NO: 2180 - protein, 540 aa, Artificial Sequence; identical to SEQ ID NO: 681
  major_capsid_protein__Norovirus__AGV76556

SEQ ID NO: 2181 - protein, 540 aa, Artificial Sequence; identical to SEQ ID NO: 681
  major_capsid_protein__Norovirus__AGV76557

SEQ ID NO: 2182 - protein, 540 aa, Artificial Sequence; identical to SEQ ID NO: 681
  major_capsid_protein__Norovirus__AGV76558

SEQ ID NO: 2183 - protein, 540 aa, Artificial Sequence; identical to SEQ ID NO: 681
  major_capsid_protein__Norovirus__AGV76559

SEQ ID NO: 2184 - protein, 540 aa, Artificial Sequence; identical to SEQ ID NO: 681
  major_capsid_protein__Norovirus__AGV76560

SEQ ID NO: 2185 - protein, 540 aa, Artificial Sequence; identical to SEQ ID NO: 681
  major_capsid_protein__Norovirus__AGV76561

SEQ ID NO: 2186 - protein, 540 aa, Artificial Sequence; identical to SEQ ID NO: 681
  major_capsid_protein__Norovirus__AGV76562

SEQ ID NO: 2187 - protein, 540 aa, Artificial Sequence; identical to SEQ ID NO: 681
  major_capsid_protein__Norovirus__AGV76563

SEQ ID NO: 2188 - protein, 540 aa, Artificial Sequence
  major_capsid_protein__Norovirus__AGV76564
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPSMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2189 - protein, 540 aa, Artificial Sequence; identical to SEQ ID NO: 681
  major_capsid_protein__Norovirus__AGV76565

SEQ ID NO: 2190 - protein, 540 aa, Artificial Sequence; identical to SEQ ID NO: 681
  major_capsid_protein__Norovirus__AGV76566

SEQ ID NO: 2191 - protein, 540 aa, Artificial Sequence
  major_capsid_protein__Norovirus__AGV76567
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2192 - protein, 540 aa, Artificial Sequence
  major_capsid_protein__Norovirus__AGV76568
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVIDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2193 - protein, 540 aa, Artificial Sequence; identical to SEQ ID NO: 681
  major_capsid_protein__Norovirus__AGV76569

SEQ ID NO: 2194 - protein, 540 aa, Artificial Sequence; identical to SEQ ID NO: 681
  major_capsid_protein__Norovirus__AGV76570

SEQ ID NO: 2195 - protein, 540 aa, Artificial Sequence
  major_capsid_protein__Norovirus__AGV76571
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYIMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2196 - protein, 540 aa, Artificial Sequence
  major_capsid_protein__Norovirus__AGV76572
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 2197 - protein, 540 aa, Artificial Sequence; identical to SEQ ID NO: 679
  major_capsid_protein__Norovirus__AGV76573

SEQ ID NO: 2198 - protein, 540 aa, Artificial Sequence
  major_capsid_protein__Norovirus__AGV76574
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 2199 - protein, 540 aa, Artificial Sequence
  major_capsid_protein__Norovirus__AGV76575
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDNDFEANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRRAV

SEQ ID NO: 2200 - protein, 540 aa, Artificial Sequence; identical to SEQ ID NO: 679
  major_capsid_protein__Norovirus__AHA44844

SEQ ID NO: 2201 - protein, 540 aa, Artificial Sequence
  major_capsid_protein__Norovirus__AHA44847
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSRNYTMNLASQNWNNYDPTEEIPAPLGTPDFVGKIQGVLTQTTRADGSTRGHKAIVYTGSADFAPKLGRVQFETDTDHDFEANQNTKFTPVGVTQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRVV

SEQ ID NO: 2202 - protein, 540 aa, Artificial Sequence
  major_capsid_protein__Norovirus__AHB62404
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSSNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGATTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2203 - protein, 540 aa, Artificial Sequence; identical to SEQ ID NO: 681
  major_capsid_protein__Norovirus__AHB62406

SEQ ID NO: 2204 - protein, 540 aa, Artificial Sequence
  major_capsid_protein__Norovirus__AID51515
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLPGTTQLSPVNICTFRGDVTHITGSRNYTMNLASQNWNNYDPTEEIPAPLGTPDFVGKIQGVLTQTTRSDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2205 - protein, 540 aa, Artificial Sequence; identical to SEQ ID NO: 673
  major_capsid_protein__Norovirus__AID51517

SEQ ID NO: 2206 - protein, 540 aa, Artificial Sequence
  major_capsid_protein__Norovirus__AID51519
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSRYVTVAHTGQHDLVIPPNGYFRFDSWVNQFYTLAPMGNGTGRRRAL

SEQ ID NO: 2207 - protein, 540 aa, Artificial Sequence
  major_capsid_protein__Norovirus__AID51522
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2208 - protein, 540 aa, Artificial Sequence; identical to SEQ ID NO: 679
  major_capsid_protein__Norovirus__AID51531

SEQ ID NO: 2209 - protein, 540 aa, Artificial Sequence; identical to SEQ ID NO: 625
  major_capsid_protein__Norovirus__AID51534

SEQ ID NO: 2210 - protein, 540 aa, Artificial Sequence; identical to SEQ ID NO: 625
  major_capsid_protein__Norovirus__AIL49840

SEQ ID NO: 2211 - protein, 540 aa, Artificial Sequence
  major_capsid_protein__Norovirus__AIL49843
MKMASSDANPSDGSAANLVPEVNNEVMALEPFVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDLTEEIPAPLGTPDFVGKIQGVLTQTTRTDGSTRGHKATVYTGSADFAPKLGRVQFETDTDHDFEANQNTKFTPVGVIQDGGTTHRSEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2212 - protein, 540 aa, Artificial Sequence
  major_capsid_protein__Norovirus__AIV99914
MKMASSDANPSDGSAANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKVIFAAVPPNFPTEGLSPSQVTMFPHIVVDARQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNSRCTTDGVLLGTTQLSPVNICTFRGDVTHITGSRNYTMNLASQNWNNYDPTEEIPVPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQGAAPAQSDVALLRFVNPDTGRVLFECKLHKSGYVTVAHTGQHDLVIPPNGYFRFDSWVNQFYTLAPMGNGTGRRRAV

SEQ ID NO: 2213 - protein, 544 aa, Artificial Sequence
  major_capsid_protein__Norovirus__AJP13619
MASKDAPQSADGASGAGQLVPEVNTADPLPMEPVAGPTTAVATAGQVNMIDPWIVNNFVQSPQGEFTISPNNTPGDILFDLQLGPHLNPFLSHLSQMYNGWVGNMRVRILLAGNAFSAGKIIVCCVPPGFTSSSLTIAQATLFPHVIADVRTLEPIEMPLEDVRNVLYHTNDNQPTMRLVCMLYTPLRTGGGSGNSDSFVVAGRVLTAPSSDFSFLFLVPPTIEQKTRAFTVPNIPLQTLSNSRFPSLIQGMILSPDASQVVQFQNGRCLIDGQLLGTTPATSGQLFRVRGKINQGARTLNLTEVDGKPFMAFDSPAPVGFPDFGKCDWHMRISKTPNNTSSGDPMRSVSVQTNVQGFVPHLGSIQFDEVFNHPTGDYIGTIEWISQPSTPPGTDINLWEIPDYGSSLSQAANLAPPVFPPGFGEALVYFVSAFPGPNNRSAPNDVPCLLPQEYITHFVSEQAPTMGDAALLHYVDPDTNRNLGEFKLYPGGYLTCVPNGVGAGPQQLPLNGVFLFVSWVSRFYQLKPVGTASTARGRLGVRRI

SEQ ID NO: 2214 - protein, 543 aa, Artificial Sequence
  major_capsid_protein__Norovirus__AJP13620
MASKDAPTNMDGTSGAGQLVPEANTAEPISMEPVAGAVTAAATAGQVNMIDPWIMNNYVQAPQGEFTISPNNTPGDILFDLQLGPHLNPFLSHLAQMYNGWVGNMKVRVLLAGNAFTAGKIIISCIPPGFVAQNISIAQATMFPHVIADVRVLEPIEVPLEDVRNVLFHNNDNTPTMRLVCILYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLGWVSPVSDGHKRDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNTSGTGPQTLPINGVFVFVSWVSRFYQLKPVGTAGPARRLGIRRS

SEQ ID NO: 2215 - protein, 548 aa, Artificial Sequence
  major_capsid_protein__Norovirus__AJP13621
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFSLPILTISEMSNSRFPVPIDSLHTSPTENIVVQCQNGRVTLDGELMGTTQLLPSQICTFRGVLTRSTSRASDQADTATPRLFNYYWHIQLDNLNGTPYDPAEDIPGPLGTPDFRGKVFGVASQRNPDSTTRAHEAKIDTTSGRFTPKLGSLEISTESDDFDQNKPTRFTPVGIGVDHEADFQQWALPDYAGQFTHNMNLAPAVAPNFPGEQLLFFRSQLPSSGGRSNGILDCLVPQEWVQHFYQESAPSQSQVALVRYINPDTGRVLFEAKLHKLGFITIAKNGDSPITVPPNGYFRFESWVNPFYTLAPMGTGNGRRRIQ

SEQ ID NO: 2216 - protein, 550 aa, Artificial Sequence
  major_capsid_protein__Norovirus__AJP13622
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGTQEQGHYATRAHEAHIDTTDPKYAPKLGTILIKSESTDFTTNQPIRFTPVGMGDNNWRQWELPDYSGRLTLNMNLAPAVSPSFPGERILFFRSIVPSAGGFGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2217 - protein, 537 aa, Artificial Sequence
  major_capsid_protein__Norovirus__AJP13623
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPRMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGDNHVWNMQVTNINGTPFDPTEDVPAPLGTPDFSGKLFGVLSQRDHDNACRSHDAVIATDSAKFTPKLGAIQIGTWEEDDVHINQPTKFTPVGLFEREGFNQWTLPNYSGALTLNMGLAPPVAPTFPGEQILFFRSHIPLKGGVADPVIDCLLPQEWIQHLYQESAPSQTDVALIRFTNPDTGRVLFEAKLHRSGYITVANTGSRPIVVPANGYFRFDSWVNQFYSLAPMGTGNGRRRVQKG

SEQ ID NO: 2218 - protein, 540 aa, Artificial Sequence
  major_capsid_protein__Norovirus__AJW67354
MMMASKDAPTSPDGASGAGQLVPEANTAEQISMDPVAGASTAVATAGQVNMIDPWIFNNFVQAPQGEFTISPNNTPGDILFDLQLGPHLNPFLAHLSQMYNGWVGNMRVRILLAGNAFTAGKIIICCVPPGFDARILTIAQATLFPHLIADVRTLEPVELPLEDVRNVLYHNSSQPQPTMRLVAMLYTPLRTGGGSGGTDAFVVAGRVLTCPAPDFSFLFLVPPSVEQKTRVFSVPNIPLKDLSNSRVPVPVQGMFVSPDVNQSVQFQNGRCQIDGQLQGTTPVSLSQLCKIRGKTSSNARVLNLSEVDGTPFIPLESPAPVGFPDLGGCDWHVNFTFQTQDRDPSQSVTFATNDASFVPYLGSVSPHNGEGFQAGDIIGSLGWISAPSDNSQFNVWAIPKYGSSLPDVTHLAPAVFPPGFGEVILYFYSTFPGSGQPSQLQVPCLLPQEFITHFCNEQAPIAGEAALLHYVDPDTGRNLGEFKLYPDGFMTCVPNSVSSGPQTLPINGVFVFVSWVSRFYQLKPVGTASAARRLGLRRI

SEQ ID NO: 2219 - protein, 547 aa, Artificial Sequence
  major_capsid_protein__Norovirus__AJW67357
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSIGATRAHEVHIDTTNPRYTPKLGSVLMYSESSDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFVTVANSGNNPIVVPPNGYFRFEAWVNQFYTLTPMGTGQGRRRIQ

SEQ ID NO: 2220 - protein, 547 aa, Artificial Sequence
  major_capsid_protein__Norovirus__AJW67359
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQASRSADSTDSAPRVRNHPLHVQLKNLDGTPYDPTDEVPAVLGAIDFKGTVFGVASQRNTTGNSIGATRAHEAHIDTTNPRYTPKLGSVLMYSESSDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2221 - protein, 547 aa, Artificial Sequence
  major_capsid_protein__Norovirus__AJW67362
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSIGATRAHEVHIDTTNPRYTPKLGSVLMYSESTDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2222 - protein, 538 aa, Artificial Sequence; identical to SEQ ID NO: 1788
  major_capsid_protein__Norovirus__AJW67368

SEQ ID NO: 2223 - protein, 538 aa, Artificial Sequence; identical to SEQ ID NO: 1788
  major_capsid_protein__Norovirus__AJW67371

SEQ ID NO: 2224 - protein, 540 aa, Artificial Sequence
  major_capsid_protein__Norovirus__AJW67374
MASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGRFTPKIGTIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGNYPLVVPPNGHFRFDSWVNQFYSLAPMGTGNGRRRVQ

SEQ ID NO: 2225 - protein, 544 aa, Artificial Sequence
  major_capsid_protein__Norovirus__AJW67377
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEMSKIPNSSTESNPIVVNSVKPNSQQFVPHLSSITLDDNVSSGGDYIGTIQWTSPPSDSGGANTNFWKIPNYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRLGVRR

SEQ ID NO: 2226 - protein, 538 aa, Artificial Sequence
  major_capsid_protein__Norovirus__AJX18190
MASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPPQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 2227 - protein, 538 aa, Artificial Sequence; identical to SEQ ID NO: 1788
  major_capsid_protein__Norovirus__AJX18193

SEQ ID NO: 2228 - protein, 540 aa, Artificial Sequence; identical to SEQ ID NO: 802
  major_capsid_protein__Norovirus__AJZ77004

SEQ ID NO: 2229 - protein, 540 aa, Artificial Sequence; identical to SEQ ID NO: 523
  major_capsid_protein__Norovirus__AJZ77010

SEQ ID NO: 2230 - protein, 540 aa, Artificial Sequence
  major_capsid_protein__Norovirus__AJZ77013
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2231 - protein, 540 aa, Artificial Sequence; identical to SEQ ID NO: 533
  major_capsid_protein__Norovirus__AJZ77015

SEQ ID NO: 2232 - protein, 540 aa, Artificial Sequence; identical to SEQ ID NO: 531
  major_capsid_protein__Norovirus__AJZ77019

SEQ ID NO: 2233 - protein, 540 aa, Artificial Sequence; identical to SEQ ID NO: 625
  major_capsid_protein__Norovirus__AJZ77022

SEQ ID NO: 2234 - protein, 540 aa, Artificial Sequence; identical to SEQ ID NO: 897
  major_capsid_protein__Norovirus__AJZ77027

SEQ ID NO: 2235 - protein, 540 aa, Artificial Sequence; identical to SEQ ID NO: 679
  major_capsid_protein__Norovirus__AJZ77030

SEQ ID NO: 2236 - protein, 540 aa, Artificial Sequence; identical to SEQ ID NO: 22
  major_capsid_protein__Norovirus__AJZ77033

SEQ ID NO: 2237 - protein, 540 aa, Artificial Sequence; identical to SEQ ID NO: 22
  major_capsid_protein__Norovirus__AJZ77036

SEQ ID NO: 2238 - protein, 540 aa, Artificial Sequence
  major_capsid_protein__Norovirus__AKE31849
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQATRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2239 - protein, 540 aa, Artificial Sequence
  major_capsid_protein__Norovirus__AKE31852
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYVGGFEVQVILAGNAFTAGKIIFAAVPPNFPTEGLSPSQVTMFPHIIVDVRQLEPVLIPLPDVRNNFHHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRIQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2240 - protein, 540 aa, Artificial Sequence
  major_capsid_protein__Norovirus__AKE31855
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFVVQVILAGNAFTAGKIIFAAVPPNFPTEGLSPSQVTMFPHIIVDARQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTDGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2241 - protein, 540 aa, Artificial Sequence
  major_capsid_protein__Norovirus__AKE31858
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKTQGVLTQTTKTNGSTRGHKATVYTGSADFSPKLGRVQFATDTDNDFETNQNTKFTPVGVIQDGSTTPRDEPQQWVLPSYSGRNTHNVHLAPAVAPTFPGEQLLFFRSTMPGCSGYPNMDLDRLLPQEWVQYFYQEPAPAQSDVALLRFVNPDTGRVLFECKLHKSGYVTVAHTGQHDLVIPPNGYFRFDSWVNQFYTLAPMGNGTGRRRAL

SEQ ID NO: 2242 - protein, 540 aa, Artificial Sequence
  major_capsid_protein__Norovirus__AKE31861
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIARLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFHTLAPMGNGTGRRRAL

SEQ ID NO: 2243 - protein, 540 aa, Artificial Sequence
  major_capsid_protein__Norovirus__AKE31864
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNIRTFRGDVTHIPGSRNYTMNSASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2244 - protein, 540 aa, Artificial Sequence
  major_capsid_protein__Norovirus__AKE31867
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVSIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2245 - protein, 540 aa, Artificial Sequence
  major_capsid_protein__Norovirus__AKE31870
MKMASSDANPSDGSTANLVPEVNNEVMALEPVVGASIAAPVAGQQNVIDPWIRNNFVQAPGGEFTVSPRNAPGEILWSAPLGPDLNPYLPHLARMYNGYAGGFEVQVILAGNAFTAGKIIFAAVPPNFPTEGLSPSQVTMFPHIIVDVRQLEPVLIPLPDVRNNFYHYYQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNESQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2246 - protein, 540 aa, Artificial Sequence
  major_capsid_protein__Norovirus__AKE31873
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWMLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2247 - protein, 540 aa, Artificial Sequence
  major_capsid_protein__Norovirus__AKE31876
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNARDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPNYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2248 - protein, 543 aa, Artificial Sequence
  major_capsid_protein__Norovirus__AKF02368
MKMASNDAAPSNDGAAGLVPEINNETMALEPVAGGAIAAPLTGQTNFIDPWIRGNYVQAPNGEFTVSPRNSPGEILLNLELGPELNPFLSHLSRMYNGYAGGIDVQVIMAGNAFTAGKIIFAAIPPHFPVENLSPPQITMFPHIIVDVRTLEPINIPVPDVRNNFFHYNQNNESRMRLVAMLYTPLRSNGSAEDVFTVSCRVLTKPSADFEFNYLVPPTVESRTKPFTIPILTIGEMTNSRFPVPIDMLHTSPTENIVVQPQNGRCTIDGELLGTTQLITSNICSFRGSISGHEGNDDQHLWHFNITNPNGTPFDPTEDVPAPLGTPDFRGQLYGVISQRDREGTPSENNQKANRSHEGVISTISPKFVPKLGSVMIGTWTTDDIKNQPSKFTPIGLNDDDNFKQWELPNYSGALTLNMGLAPSVFPTYPGEQVLFFRSYLPMKGGYGSPFIDCLVPQEWVAHFYQESAPAQTDVALIRYVNPETGRVLFEAKLHRQGFITVAKSGDSPINVPANGYFRFDSWVNQFYSLAPMGTGNGRRRIQ

SEQ ID NO: 2249 - protein, 547 aa, Artificial Sequence
  major_capsid_protein__Norovirus__AKF42429
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSIGATRAHEVHIDTTNPRYTPKLGSVLMYSESTDFDDGQPTRFTPIGMGADDWHQWELPEYSGHLTLSMSLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2250 - protein, 547 aa, Artificial Sequence
  major_capsid_protein__Norovirus__AKF42434
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSIGATRAHEVHIDTTNPRYTPKLGSVLMYSESSDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2251 - protein, 549 aa, Artificial Sequence
  major_capsid_protein__Norovirus__AKF42437
MKMASTDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVKNISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNEGVVVQPQNGRCTLDGTLQGTTQLVPTQICAFRGKLIGQTSRSPDSDSTDSAPRRRDHPLHVQLENLDGTQYDPTDEVPATLGAVDFKGTIFGVASQRDTSGSQVGATRAHEVHINTTDPRYTPKLGSILMYSESLDFETGQPVRFTPIGMGENDWHQWELPDYSGRLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 2252 - protein, 540 aa, Artificial Sequence; identical to SEQ ID NO: 472
  major_capsid_protein__Norovirus__ALA27427

SEQ ID NO: 2253 - protein, 540 aa, Artificial Sequence
  major_capsid_protein__Norovirus__ALD09618
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDARNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2254 - protein, 540 aa, Artificial Sequence
  major_capsid_protein__Norovirus__ALM96644
MKMASSDANPSDGSTANLIPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDIFTVSCRVLTRPSPDFDFIFLVPPTVESRTKPFSVPVLTVEEMTNSRFPIPLEKLFTGPSSALVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2255 - protein, 540 aa, Artificial Sequence
  major_capsid_protein__Norovirus__ALM96645
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGGDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKVQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTVRVLFECKLHKSGYVTVAHTGQHDLVIPPNGYFRFDSWVNQFYTLAPMGNGTGRRRAL

SEQ ID NO: 2256 - protein, 540 aa, Artificial Sequence
  major_capsid_protein__Norovirus__ALM96646
MKMASNDANPSDGSAANLVPKVNNEVMALEPVVGAAIAAPVAGQQNVIDPWIKNNFVQAPGGKFTVSPKNAPGEILWSAPLGPDLNPYLSHLARMYKGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2257 - protein, 540 aa, Artificial Sequence
  major_capsid_protein__Norovirus__ALM96647
MKMASNDANPSDGSAANLVPKVNNEVMALEPVVGAAIAAPVAGQQNVIDPWIRNNFVQAPGGKFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2258 - protein, 540 aa, Artificial Sequence; identical to SEQ ID NO: 1000
  major_capsid_protein__Norovirus__ALM98891

SEQ ID NO: 2259 - protein, 540 aa, Artificial Sequence; identical to SEQ ID NO: 1000
  major_capsid_protein__Norovirus__ALM98892

SEQ ID NO: 2260 - protein, 540 aa, Artificial Sequence; identical to SEQ ID NO: 1000
  major_capsid_protein__Norovirus__ALM98893

SEQ ID NO: 2261 - protein, 540 aa, Artificial Sequence; identical to SEQ ID NO: 1000
  major_capsid_protein__Norovirus__ALM98894

SEQ ID NO: 2262 - protein, 540 aa, Artificial Sequence; identical to SEQ ID NO: 1000
  major_capsid_protein__Norovirus__ALM98895

SEQ ID NO: 2263 - protein, 540 aa, Artificial Sequence; identical to SEQ ID NO: 359
  major_capsid_protein__Norovirus__ALM98896

SEQ ID NO: 2264 - protein, 540 aa, Artificial Sequence; identical to SEQ ID NO: 1000
  major_capsid_protein__Norovirus__ALM98897

SEQ ID NO: 2265 - protein, 540 aa, Artificial Sequence; identical to SEQ ID NO: 1000
  major_capsid_protein__Norovirus__ALM98899

SEQ ID NO: 2266 - protein, 540 aa, Artificial Sequence; identical to SEQ ID NO: 677
  major_capsid_protein__Norovirus__ALM98901

SEQ ID NO: 2267 - protein, 540 aa, Artificial Sequence
  major_capsid_protein__Norovirus__ALM98907
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNIPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2268 - protein, 540 aa, Artificial Sequence
  major_capsid_protein__Norovirus__ALM98910
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQDAAPAQSDVALLRFVNPDTGRVLFECKLHKSGYVTVAHTGQHDLVIPPNGYFRFDSWVNQFYTLAPMGNGTGRRRAL

SEQ ID NO: 2269 - protein, 540 aa, Artificial Sequence
  major_capsid_protein__Norovirus__ALM98913
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRSTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2270 - protein, 540 aa, Artificial Sequence; identical to SEQ ID NO: 868
  major_capsid_protein__Norovirus__ALM98916

SEQ ID NO: 2271 - protein, 540 aa, Artificial Sequence
  major_capsid_protein__Norovirus__ALT54478
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRADGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2272 - protein, 538 aa, Artificial Sequence
  major_capsid_protein__Norovirus__ALT54488
MMMASKDAPSNMDGTSGAGQLVPEVNAAEPLPLEPVVGAATAAATAGQVNMIDPWIMNNFVQAPEGEFTISPNNTPGDILFDLRLGPHLNPFLLHLSQMYNGWVGNMRVRVMLAGNAFSAGKIIICCVPPGFESQNISIGQATMFPHVIADVRVLEPIEVPLDDVRNVLFHTNENRPTMRLLCMLYTPLRAGGASSGTDPFVIAGRVLTCPAPDFNFLFLVPPSVEQKTRQLTIPNIPLNNLANSRVPAMINKMTVSADQNQVVQFQNGRCTLEGQLLGTTPVSANQVARIRGKVFSTNSGTGLNLTEVDGTPYHAFESPAPLGFPDIGNCDWHVYAFKVNQNTGDPMYRLDITQGNSFAPHLGSIEFSSENHPSGDQLGTLTWISPLNNASRVDPWKIPTYGSTLTESTNLAPPIFPPGFGESIVYFMSDFPIVSGNTAQIPCTLPQEFVSSFVEQQAPIRGEAALLHYVDPDTHRNLGEFKLYPDGFITCVPNTGGGPQNLPSNGVFVFSSWVSRYYQLKPVGTTGPVRRLGVRRV

SEQ ID NO: 2273 - protein, 539 aa, Artificial Sequence
  major_capsid_protein__Norovirus__ALT54491
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFTVPILTVEEMTNSRFPIPLEKLFTGPSNAFVVQPQNGRCTTDGVLLGTTQLSPVNICTFRGDVTQIASTQTYTMNLASLNWNNYDPTEEIPAPLGAPDFMGKIQGVLTQTTRQGGSTRGHKATVSTGSVHFTPKLGSVRFDTDTNNDLQPHQSTRFTPVGVIQDGDTHQNEPQQWALPCYSGRDVNNVHLAPAVAPSFPGEQLLFFRSTMPGCSGYPNMDLDCLLPQEWVQHFYQEAAPAQSDVALLRFVNPDTGRVLFECKLHKSGYVTVAHTGQHNLVIPPNGYFRFDSWVNQFYTLAPMGNGTGRRRVL

SEQ ID NO: 2274 - protein, 539 aa, Artificial Sequence
  major_capsid_protein__Norovirus__ALT54494
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFTVPILTVEEMTNSRFPIPLEKLFTGPSNAFVVQPQNGRCTTDGVLLGTTQLSPVNICTFRGDVTQIASTQTYTMNLASLNWNNYDPTEEIPAPLGAPDFMGKIQGVLTQTTRQDGSTRGHKATVSTGSVHFTPKLGSVRFDTDTNNNLQPHQSTRFTPVGVIQDGDTHQNEPQQWVLPCYSGRDVNNVHLAPAVAPSFPGEQLLFFRSTMPGCSGYPNMDLDCLLPQEWVQHFYQEAAPAQSDVALLRFVNPDTGRVLFECKLHKSGYVTVAHTGQHNLVIPPNGYFRFDSWVNQFYTLAPMGNGTGRRRVL

SEQ ID NO: 2275 - protein, 539 aa, Artificial Sequence
  major_capsid_protein__Norovirus__BAM65003
MMMASKDAPSNMDGTSGAGQLVPEVNAAEPLPLEPVVGAATAAATAGQVNLIDPWIMNNFVQAPEGEFTISPNNTPGDILFDLQLGPHLNPFLQHLSQMYNGWVGNMRVRVMLAGNAFTAGKIIICCVPPGFASQNISIGQATMFPHVIADVRVLEPIEIPLDDVRNVLFHTNENRPTMRLLCMLYTPLRAGGASSGTDPFVIAGRVLTCPSPDFNFLFLVPPSVEQKTRQLTVPNIPLNNLANSRVPAMINKMTVSTDQNQVVQFQNGRCTLEGQLLGTTPVSASQVARIRGKVFSTASGKGLNLTELDGTPYHAFESPAPLGFPDIGACDWHVSTFKVDQNLSGDPMSRLDIKQNAPFAPHLGSIEFTSDQEPTGDQLGTLAWVSPSTSGARVDPWKIPSYGSTVTESTHLAPPIFPPGFGEAIVYFMSDFPIVSGNTAQVPCTLPQEFVSHFVEQQAPIRGEAALLHYVDPDTHRNLGEFKLYPDGFITCVPNTGGGPQNLPINGVFVFSSWVSRYYQLKPVGTAGPARRLGVRRV

SEQ ID NO: 2276 - protein, 548 aa, Artificial Sequence
  major_capsid_protein__Norovirus__BAM65005
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTSGRFTPKLGSLEISTESGDFDQNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKSGDSPITVPPNGYFRFESWVNPFYTLAPMGTGNGRRRIQ

SEQ ID NO: 2277 - protein, 547 aa, Artificial Sequence
  major_capsid_protein__Norovirus__BAM65007
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGTVFGVASQRDVSGQQVGATRAHEVHINTTDPRYTPKLGSILMHSESDDFVTGQPVRFTPIGMGDNDWHQWELPDYSGHLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 2278 - protein, 540 aa, Artificial Sequence; identical to SEQ ID NO: 22
  major_capsid_protein__Norovirus__CCX28604

SEQ ID NO: 2279 - protein, 540 aa, Artificial Sequence
  major_capsid_protein__Norovirus__CCX28607
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLVPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFEANQNTKFTPVGVIQDGSTAHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRRAL

SEQ ID NO: 2280 - protein, 540 aa, Artificial Sequence
  major_capsid_protein__Norovirus__CCX28619
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2281 - protein, 540 aa, Artificial Sequence
  major_capsid_protein__Norovirus__CCX28622
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLAAQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2282 - protein, 540 aa, Artificial Sequence; identical to SEQ ID NO: 2280
  major_capsid_protein__Norovirus__CCX28625

SEQ ID NO: 2283 - protein, 540 aa, Artificial Sequence; identical to SEQ ID NO: 2281
  major_capsid_protein__Norovirus__CCX28628

SEQ ID NO: 2284 - protein, 540 aa, Artificial Sequence; identical to SEQ ID NO: 22
  major_capsid_protein__Norovirus__CCX28631

SEQ ID NO: 2285 - protein, 540 aa, Artificial Sequence; identical to SEQ ID NO: 2280
  major_capsid_protein__Norovirus__CCX28634

SEQ ID NO: 2286 - protein, 540 aa, Artificial Sequence
  major_capsid_protein__Norovirus__CCX28637
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2287 - protein, 540 aa, Artificial Sequence; identical to SEQ ID NO: 22
  major_capsid_protein__Norovirus__CCX28640

SEQ ID NO: 2288 - protein, 540 aa, Artificial Sequence; identical to SEQ ID NO: 2280
  major_capsid_protein__Norovirus__CCX28643

SEQ ID NO: 2289 - protein, 540 aa, Artificial Sequence; identical to SEQ ID NO: 22
  major_capsid_protein__Norovirus__CCX28646

SEQ ID NO: 2290 - protein, 540 aa, Artificial Sequence; identical to SEQ ID NO: 214
  major_capsid_protein__Norovirus__CCX28649

SEQ ID NO: 2291 - protein, 540 aa, Artificial Sequence; identical to SEQ ID NO: 2281
  major_capsid_protein__Norovirus__CCX28652

SEQ ID NO: 2292 - protein, 541 aa, Artificial Sequence; identical to SEQ ID NO: 377
  major_capsid_protein_VP1__Norovirus__AEE10000

SEQ ID NO: 2293 - protein, 541 aa, Artificial Sequence; identical to SEQ ID NO: 380
  major_capsid_protein_VP1__Norovirus__AEE10012

SEQ ID NO: 2294 - protein, 540 aa, Artificial Sequence; identical to SEQ ID NO: 947
  major_capsid_protein_VP1__Norovirus__AGJ52172

SEQ ID NO: 2295 - protein, 540 aa, Artificial Sequence; identical to SEQ ID NO: 871
  major_capsid_protein_VP1__Norovirus__AGJ52173

SEQ ID NO: 2296 - protein, 540 aa, Artificial Sequence; identical to SEQ ID NO: 681
  major_capsid_protein_VP1__Norovirus__AGJ52174

SEQ ID NO: 2297 - protein, 543 aa, Artificial Sequence; identical to SEQ ID NO: 1001
  major_capsid_protein_VP1__Norovirus__AGJ52176

SEQ ID NO: 2298 - protein, 535 aa, Artificial Sequence
  major_capsid_region__Norovirus__ADO85555
MKMASNDAAPSNDGAAGLVPEVNNETMALEPVAGASIAAPLTGQNNVIDPWIRLNFVQAPNGEFTVSPRNSPGEVLLNLELGPELNPYLAHLSRMYNGYAGGVEVQVLLAGNAFTAGKLVFAAVPPHFPLENISPGQITMFPHVIIDVRTLEPVLLPLPDVRNNFFHYNQQNEPWMRLVAMLYTPLRSNGSGDDVFTVSCRVLTRPSPDFDFNYLVPPTVESKTKPFTLPILTIGELTNSRFPVPIDELYTSPNESLVVQPQNGRCALDGELQGTTQLLPTAICSFRGRINQKVSGENHVWNMQVTNINGTPFDPTEDVPAPLGTPDFSGKLFGVLSQRDHDNACRSHDAVIATNSAKFTPKLGAIQIGTWEENDVHINQPTKFTPVGLFESEGFNQWTLPNYSGALTLNMGLAPPVAPTFPGEQILFFRSHIPLKGGVADPVIDCLLPQEWIQHLYQESAPSQTDVALIRITNPDTGRVLFEAKLHRSGYITVANTGSRPIVVPANGYFRFDSWVNQFYSLAPMGTGNGRRRVQ

SEQ ID NO: 2299 - protein, 541 aa, Artificial Sequence
  majore_capsid_protein__Norovirus__AFO84035
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEYQSEVGEVATFTLIEQDGSAYVPGDRAAPLGYPDYSGQLEIEVQTETTKTGDKLKVTTFDMILGPTTNVDQVPYQGKVYASLTTASSLDLVDGRARAVPRSVYSFQDVLPEYNDGLLVPLAPPLGPYLPGEVLLRFRTYMRQLDTADAAAQPIDCALPQEFISWFASNNFTVQSDALLIRYRNTLTGQLLFEAKLYSEGYIAVSYSGSGPLTFPTDGFFEVVSWVPRLFQLASVGSLVTGRTLKQ

SEQ ID NO: 2300 - protein, 540 aa, Artificial Sequence
  major_viral_capsid_protein__Norovirus__AFN09918
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTSRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKPGYVTVAHTGQHDLVIPPNGYFRFDSWVNQFYTLAPMGNGAGRRRAL

SEQ ID NO: 2301 - protein, 540 aa, Artificial Sequence; identical to SEQ ID NO: 472
  major_viral_capsid_protein__Norovirus__AFN09921

SEQ ID NO: 2302 - protein, 540 aa, Artificial Sequence
  major_viral_capsid_protein__Norovirus__AFN09924
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGNGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYITVAHTGQHDLVIPPNGYFRFDSWVNQFYTLAPMGNGTGRRRAL

SEQ ID NO: 2303 - protein, 540 aa, Artificial Sequence; identical to SEQ ID NO: 472
  major_viral_capsid_protein__Norovirus__AFN09927

SEQ ID NO: 2304 - protein, 540 aa, Artificial Sequence
  major_viral_capsid_protein__Norovirus__AFN09930
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQITKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2305 - protein, 540 aa, Artificial Sequence; identical to SEQ ID NO: 472
  major_viral_capsid_protein__Norovirus__AFN09933

SEQ ID NO: 2306 - protein, 540 aa, Artificial Sequence; identical to SEQ ID NO: 472
  major_viral_capsid_protein__Norovirus__AFN09936

SEQ ID NO: 2307 - protein, 540 aa, Artificial Sequence
  major_viral_capsid_protein__Norovirus__AFN09939
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2308 - protein, 540 aa, Artificial Sequence; identical to SEQ ID NO: 472
  major_viral_capsid_protein__Norovirus__AFN09942

SEQ ID NO: 2309 - protein, 540 aa, Artificial Sequence
  major_viral_capsid_protein__Norovirus__AFN09945
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2310 - protein, 540 aa, Artificial Sequence
  major_viral_capsid_protein__Norovirus__AFN09948
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2311 - protein, 540 aa, Artificial Sequence; identical to SEQ ID NO: 472
  major_viral_capsid_protein__Norovirus__AFN09951

SEQ ID NO: 2312 - protein, 540 aa, Artificial Sequence
  major_viral_capsid_protein__Norovirus__AFN09954
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDLIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2313 - protein, 540 aa, Artificial Sequence
  major_viral_capsid_protein__Norovirus__AFN09957
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2314 - protein, 540 aa, Artificial Sequence
  major_viral_capsid_protein__Norovirus__AFN09960
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFRGRSSALVVHPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFEYKLHKSDYVTVAHTGQHDLVIPPNGYFRFDSWVNQFYTLAAMGNGTGRRRAL

SEQ ID NO: 2315 - protein, 540 aa, Artificial Sequence
  major_viral_capsid_protein__Norovirus__AFN09963
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSASFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2316 - protein, 540 aa, Artificial Sequence; identical to SEQ ID NO: 472
  major_viral_capsid_protein__Norovirus__AFN09966

SEQ ID NO: 2317 - protein, 540 aa, Artificial Sequence; identical to SEQ ID NO: 1286
  major_viral_capsid_protein__Norovirus__AFN09969

SEQ ID NO: 2318 - protein, 540 aa, Artificial Sequence
  major_viral_capsid_protein__Norovirus__AFN09972
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2319 - protein, 530 aa, Artificial Sequence
  major_viral_capsid_protein__Norovirus__AFN09975
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPRFESRTKPFSVPVLTVEEMTNSRFPIPLEKLFTGPSSAFVVQPQNGRCTTDGVLLGTTQLSPVNICTFRGDVTHIPGSRNYTMNLASQNWNSYGPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2320 - protein, 540 aa, Artificial Sequence
  major_viral_capsid_protein__Norovirus__AFN09978
MKMASSDANPSDGSTANLVPEVNNEVMALEPVVGAAIAAPVAGQQNVIDPWIRNNFVQAPCGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2321 - protein, 540 aa, Artificial Sequence
  major_viral_capsid_protein__Norovirus__AFN09981
MKMASNDVNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2322 - protein, 540 aa, Artificial Sequence
  major_viral_capsid_protein__Norovirus__AFN09984
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVMFECKLHKSGYVTVAHTGQHDLVIPPNGYFRFDSWVNQFYTLAPMGNGTGRRRAL

SEQ ID NO: 2323 - protein, 540 aa, Artificial Sequence; identical to SEQ ID NO: 62
  major_viral_capsid_protein__Norovirus__AFN09987

SEQ ID NO: 2324 - protein, 540 aa, Artificial Sequence; identical to SEQ ID NO: 62
  major_viral_capsid_protein__Norovirus__AFN09990

SEQ ID NO: 2325 - protein, 540 aa, Artificial Sequence
  major_viral_capsid_protein__Norovirus__AFN09993
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNDRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHSVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2326 - protein, 540 aa, Artificial Sequence; identical to SEQ ID NO: 62
  major_viral_capsid_protein__Norovirus__AFN09996

SEQ ID NO: 2327 - protein, 540 aa, Artificial Sequence; identical to SEQ ID NO: 1286
  major_viral_capsid_protein__Norovirus__AFN09999

SEQ ID NO: 2328 - protein, 540 aa, Artificial Sequence
  major_viral_capsid_protein__Norovirus__AGC96529
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDIPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2329 - protein, 540 aa, Artificial Sequence
  major_viral_capsid_protein__Norovirus__AGC96532
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2330 - protein, 547 aa, Artificial Sequence
  major_viral_capsid_protein__Norovirus__AGC96535
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGSSVGATRAHEVHIDTTNPRYTPKLGSVLMHSESSDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2331 - protein, 540 aa, Artificial Sequence
  major_viral_capsid_protein__Norovirus__AGS16690
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPNYSGSDVPNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2332 - protein, 540 aa, Artificial Sequence; identical to SEQ ID NO: 2331
  major_viral_capsid_protein__Norovirus__AGS16693

SEQ ID NO: 2333 - protein, 540 aa, Artificial Sequence; identical to SEQ ID NO: 1000
  major_viral_capsid_protein__Norovirus__ALM98919

SEQ ID NO: 2334 - protein, 540 aa, Artificial Sequence; identical to SEQ ID NO: 1000
  major_viral_capsid_protein__Norovirus__ALM98922

SEQ ID NO: 2335 - protein, 540 aa, Artificial Sequence; identical to SEQ ID NO: 1000
  major_viral_capsid_protein__Norovirus__ALM98928

SEQ ID NO: 2336 - protein, 540 aa, Artificial Sequence; identical to SEQ ID NO: 1000
  major_viral_capsid_protein__Norovirus__ALM98931

SEQ ID NO: 2337 - protein, 540 aa, Artificial Sequence; identical to SEQ ID NO: 359
  major_viral_capsid_protein__Norovirus__ALM98934

SEQ ID NO: 2338 - protein, 540 aa, Artificial Sequence
  major_viral_capsid_protein__Norovirus__ALM98940
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2339 - protein, 540 aa, Artificial Sequence; identical to SEQ ID NO: 1000
  major_viral_capsid_protein__Norovirus__ALM98943

SEQ ID NO: 2340 - protein, 540 aa, Artificial Sequence
  putative_capsid_protein__Norovirus__ABD73936
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHVIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRAL

SEQ ID NO: 2341 - protein, 519 aa, Artificial Sequence
  structural_capsid_protein__Norovirus__ABY67257
MKMTDKDTQEAAPALGQVLPPEVEVAIPVEPTAGAQIAAPTAGQVNPIDPWIFANFVQAPQGEFTISPNNNPGEVLFELELGPELNPYLAHLRQMYNGWTGSIRVKVILAGNAFSAGKIIVFCIPPGFDASYLTPFQATQFPHVIMDVRAAEPIEIPLADVRNVLFHQGPDSRMRLMGMLYTPLRANSGADPFVVTGRVLTCPSPDFSFFFLVPPTVEERSTPFSVPNVPVYSLTNSRAPVPIYELRSSRSLPLTVQFQNGRCTVEGDLLGTTPFSAGDLCSFMCIRGDTQHIAELLEPDESAFVVGERPATLGFPDFSQCVLHLLLADGTGIWHQSLDVKNPQHFTPAIGQVVLSGDVPLTRTRVRLDYVLSTSRDSFWVLPDYRSDVLGSEFAPAVSAPGVGETLLFFMGRAPVQGPSNPLPCLLPLEWVFHFASERPTKQSDVALLNYVNPDTGRVLFEAKLYSSGFLTVNLGTANEVVLPTSGIFKFASWVSLYYQLRPVGTLSAGRRLPRVDGY

SEQ ID NO: 2342 - protein, 550 aa, Artificial Sequence
  viral_capsid_protein__Norovirus__AHA91656
MMMASKDATSNMDGTSGAGQLVPENNNTSEPINMEPVAGAVTAAATAGQVNMIDPWIMNNYVQAPQGEFTISPNNTPGDILFDLQLGPHLNPFLAHLSQMYNGWVGNMKVRVVLAGNAFSAGKIIVCCIPPGFSAPNISIAQATMFPHVIADVRVLEPIDIPLDDVRNVLFHNNDNGNQTMRLLCMLYTPLRSGGTSSGTDPFVIAGRVLTCPTPDFNFLFLVPPTVEQKTKQFSVPNLPLNVMSNSRVPSLLNAMVVSPDQAQVVQFQNGRCTLDGQMLGTTTVSASCVARFRGKTFQAPDNRLGINLAEISGEPYHAFESPAPLGFPDFGDGDWHVTATKVTPSQLEANDPVVMGNVQPYNPQFAPHLGTLVVENPTPDNVTTGTDLLFNITWLSNRANNRFNPWVIPNYGSTLTEAAQLAPSIFPPGFGETIVYFNSTFPAVGATTHAAIPCLLPQEFVAHFVNEQAPIRGEAALLHYIDPDTHRNLGEFKIYPEGFVTCVPNVGGTGPQSLPTNGIFVFVSWVSRYYQLKPVGTAGQARRLGFRRV

SEQ ID NO: 2343 - protein, 542 aa, Artificial Sequence; identical to SEQ ID NO: 407
  VP1_capsid_protein__Norovirus__BAL60747

SEQ ID NO: 2344 - protein, 542 aa, Artificial Sequence; identical to SEQ ID NO: 408
  VP1_capsid_protein__Norovirus__BAL60751

SEQ ID NO: 2345 - protein, 542 aa, Artificial Sequence; identical to SEQ ID NO: 415
  VP1_capsid_protein__Norovirus__BAL60763

SEQ ID NO: 2346 - protein, 542 aa, Artificial Sequence; identical to SEQ ID NO: 418
  VP1_capsid_protein__Norovirus__BAL60765

SEQ ID NO: 2347 - protein, 542 aa, Artificial Sequence; identical to SEQ ID NO: 429
  VP1_capsid_protein__Norovirus__BAL60787

SEQ ID NO: 2348 - protein, 542 aa, Artificial Sequence; identical to SEQ ID NO: 430
  VP1_capsid_protein__Norovirus__BAL60789

SEQ ID NO: 2349 - protein, 542 aa, Artificial Sequence; identical to SEQ ID NO: 441
  VP1_capsid_protein__Norovirus__BAL60807

SEQ ID NO: 2350 - protein, 129 aa, Artificial Sequence
  capsid__Norovirus__ACL14997
MASNDAAPSNDGAAGLVPESNNEVMALEPVAGASLAAPVTGQTNIIDPWIRMNFVQAPNGEFTVSPRNSPGEVLLNLELGPELNPYLAHLSRMYNGYAGGMEVQIMLAGNAFTAGKLIFAAVPPYNRRC

SEQ ID NO: 2351 - protein, 186 aa, Artificial Sequence
  truncated_capsid_protein__Norovirus__ACB56490
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVMQLEPVLIPLPDVRNNFYHYNQSNDSTIKFDSNAVYTT

SEQ ID NO: 2352 - protein, 208 aa, Artificial Sequence
  truncated_capsid_protein__Norovirus__ACF77106
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPIS

SEQ ID NO: 2353 - protein, 208 aa, Artificial Sequence
  truncated_capsid_protein__Norovirus__ACF77107
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSP

SEQ ID NO: 2354 - protein, 21 aa, Artificial Sequence
  truncated_capsid_protein__Norovirus__ACU28807
MKMASNDAHPSDGSAATSSQR

SEQ ID NO: 2355 - protein, 103 aa, Artificial Sequence
  truncated_capsid_protein__Norovirus__ACU28808
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGL

SEQ ID NO: 2356 - protein, 40 aa, Artificial Sequence
  truncated_capsid_protein__Norovirus__ACV03476
MKMASMTPTHLMGPQPTSSQRSTMRLWLWSPLSVPLLRRL

SEQ ID NO: 2357 - protein, 28 aa, Artificial Sequence
  truncated_capsid_protein__Norovirus__ACV03479
MKMASMTPLHLMMVPPASSQRSTMRQWR

SEQ ID NO: 2358 - protein, 540 aa, Artificial Sequence
  capsid_protein__Norovirus__AFN70960.1
MKMASKDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPLGNGTGRRRAL

SEQ ID NO: 2359 - protein, 542 aa, Artificial Sequence
  VP1__Norovirus_and/or_Norovirus-like__X81879
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQKITMFPHVIIDVRTLEPVLLPLPDVRNSFFHYNQKDDPKMRIVAMLYTPLRSNGSGDDVFTVSCRVLTRPSPDFDFTYLVPPTVESKTKPFTLPILTLGELSNSRFPVPIDQMYTSPNEVISVQCQNGRCTLDGELQGTTQLQVSGICAFKGEVTAHLHDNDHLNNVTITNLNGSPFDPSEDIPAPLGVPDFQGRVFGVISQRDKQNAAGHSEPANRGHDAVVPTYTAQYTPKLGQIQIGTWQTDDLTVNQPVKFTPVGLNDTEHFNQWVVPRYAGALNLNTNLAPSVAPVFPGERLLFFRSHLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2360 - protein, 575 aa, Artificial Sequence
  VP1__Norovirus_and/or_Norovirus-like__FJ875027
MKMASNDAAPPSSDGAANLVPEINNEVMALEPVAGAQLAAPVAGQFNAIDPWIRQNFVQAPEGEFTVSPRNAPGEILLNLELGPHLNPFLQHLAQMYNAYAGGMEVQVVLAGNAFTAGKIIFAAIPPHFPPERLSAAQATQFPHVIVDVRQLEPIVLPLPDVRHNLFHFNQQNDERMHLVAFLYTPLRANSGNGDDVFTVSCRVLTRPSQDFEFMFLVPPTVEKKTVAFSLPQLAVGEMSNSRWPARITGMVVDPRLPQVLHIQNGRCTLDGTLMGTTQLNPNDICRIRGYFSSSRPELLCEGEESEVNTTPTDSGATGDQTPEVRTGTRATQRWFAVTELNGQVYDPFGDQPAPLGVPDFKARILGALMRLPGTNPTSNSRFEDAWVETNNQTTYAPATGVVAITTNDNSSGNYANDQTCEFVPLGIEITDSAPYNEFDLPSYGGAASSGNRNLAPTVAPTFPGEAILLFGSNMPVYNRSSGTDNKDIRCLLPNEYVQHLYDTQAPSLSDVALVRYVNRDTGRVLFEAKLHRDGFMTVNASSTTVLPVDGYFRFDSWVNQFYALSPVGNASGRR

SEQ ID NO: 2361 - protein, 574 aa, Artificial Sequence
  VP1__Norovirus_and/or_Norovirus-like__JF939046
MKMASNDAASPSSDGAANLVPEINNEVMALEPVAGAQLAAPVAGQFNAIDPWIRQNFVQAPEGEFTVSPRNAPGEILLNLELGPHLNPFLQHLAQMYNAYAGGMEVQVVLAGNAFTAGKIIFAAVPPHFPPERLSAAQATQFPHVIVDVRQLEPIILPLPDVRHNLFHFNQQNDERMHLVAFLYTPLRANSGSGDDVFTVSCRVLTRPSQDFEFMFLVPPTVEKKTVAFSLPQLAIGEMSNSRWPARITGLVVDPRLPQVLHIQNGRCTLDGTLMGTTQLNPNDICRIRGYFSSSRPELLCENEESATDPMPTETDTDNQPPEVRAQARATQRWFAVTELNGQVYDPFGDQPAPLGVPDFKARILGALMRLPGTNPTSNSRFEDAWVETNNQTTYAPAAGVVAITTNDNSSSNYANDQTCEFVPLGIEITDSAPYHEFDLPSYGGAASSGNRNLAPTVAPTFPGEAILLFGSNMPVYNRNTGTSNKDIRCLLPNEYVQHLYDTQAPSLSDVALVRYVNRDTGRVLFEAKLHRDGFMTVNASSTTVLPVDGYFRFDSWVNQFYALSPVGNASGRR

SEQ ID NO: 2362 - protein, 573 aa, Artificial Sequence
  VP1__Norovirus_and/or_Norovirus-like__JF930689
MKMASNDATAPSQDGAANLVPESQHEVLALEPVAGAALAAPVAGQFNAIDPWIKQNFVQAPAGEFTVSPRNAPGEILMDLELGPELNPFLAHLAQMYNAYAGGMEVQIILAGNAFTAGKIIVCAVPPNFPPDRLSASQATNFPHVIMDVRTLEPVILPLPDVRAGFFHYNQLREPRMRLMALLYTPLRANGTGDDAFTVSCRVLTRPMQDFEFMFLVPPTVESRVTPFSVPTYPVVEMTNSRWPARISGMHVNANQTLAVQFQNGRCTLDGQLMGTTQLCAADVCRMRGRYTSTRADLAGVDHTDQGPSLGTGPSDDSVSVPEARAQTRTGVSAHLQLEELNGQPYEVYGEQPAPLGTPDFRCRLMGELVRLPSTSPAAQSRFRDAFFDTYGALFAPAVGSTTFTVNNSSTSDFANGQPFEFLPIGVEIGNSAQYDEFALPSYNGAIGENRHLAPVAAPGFPGENIVFFSSNLPVWDSTSAQNNRRISCLLPNEFVQHFYDLQAPSQSDVALLRYVHPESGRVLFECKLYRDGFLTVNGASLAEFPVNGYFRFDSWVNQFFTLSPVGTGSGRR

SEQ ID NO: 2363 - protein, 572 aa, Artificial Sequence
  VP1__Norovirus_and/or_Norovirus-like__GQ443611
MKMASNDATAPSQDGAANLVPESQHEVLALEPVAGAALAAPVAGQFNAIDPWIKQNFVQAPAGEFTVSPRNAPGEILMDLELGPELSPFLAHLAQMYNAYAGGMEVQIILAGNAFTAGKIIVCAVPPNFPPDRLSASQATNFPHVIMDVRTLEPVILPLPDVRAGFFHYNQLREPRMRLMALLYTPLRANGTGDDAFTVSCRVLTRPMQDFEFMFLVPPTVESRVTPFSVPTYPVVEMTNSRWPARISGMHVNANQTLAVQFQNGRCTLDGQLMGTTQLCAADVCRMRGRYTSTRADLAGVDHTDQGPSLGAGPSNDPVSVPEARSQTRTSVSAHLQLEELNGQPYEVYGEQPAPLGTPDFCCRLMGELVRLPSTSPAAQSRFRDAFFDTYGALFAPAVGSTTFTVNNSSTSDFANGQPFEFLPIGVEIGNSAQYDEFALPSYNGAIGENRHLAPVAAPGFPGENIVFFSSNLPVWDSTSAQNNRRISCLLPNEFVQHFYDLQAPSQSDVALLRYVHPESGRVLFECKLYRDGFLTVNGASLAEFPVNGYFRFDSWVNQFFTLSPVGTGSGR

SEQ ID NO: 2364 - protein, 572 aa, Artificial Sequence
  VP1__Norovirus_and/or_Norovirus-like__EU224456
MKMASNDAAPSSDGAGNLVPESHQEVLPLAPVAGAAIAAPVVGQQNIIDPWIKENFVQAPQGEFTVSPKNSPGEVLVNLELSPKLNPYLDHLSKMYNAYAGGMEIEIILAGNAFTAGKVLIAAVPPNFPVENISVSQASQFPHVIVDVRTLEPIRLPLPDVRTNFFHYTTRDEPKMRIVAWLYTPLRTNGSGDDSFTVSGRILTRPSADFEFSFLVPPTVETKTVSFSVPGLTVEEMSNSRWPAQINGLVVRGNEAQVVHFQNGRCTTEGMLLGTTTLNVNSICGLRGTSISHASVREAPALSEEMPPLEDEVAHGAAATYAVGRAADTTLWIRVEEPNGQPYDIFGEQPAPLGTPDFTAVIIGTAIRPRTASGAYLHDAYVDTRPGDADFTPSTGNTKIVLRGGGSGHVGEGHYWQFKPIAVEGGPNRPVYQEYNLPEYAGPTASNHNLAPPVAPKMPGELLLLFESDMPVWDNGSGSAPTQKIHCLLPNDFVTHFFDLQAPALAEAALLRYVHPDSGRTLFECKLYREGYMVVVAPSGRLDFPLDGYFRFDSWVNAFYVLSPVGNGQGRR

SEQ ID NO: 2365 - protein, 572 aa, Artificial Sequence
  VP1__Norovirus_and/or_Norovirus-like__EF450827
MKMASSDATPSSDGAGNLVPESQQEVLPLAPVAGAALAAPVVGQQNIIDPWIKENFVQAPQGEFTVSPKNSPGEVLVNLELSPRLNPYLHHLSKMYNAYAGGMEVEIILAGNAFTAGKVLIAAVPPNFPIENVSASQASQFPHVIVDVRTLEPIRLPLPDVRTNFFHYTTQEEPRMRIVAWLYTPLRTNGSGDDSFTVSGRILTRPSPDFEFSFLVPPTVETKTVSFSVPGLVVQDMSNSRWPAQISGLVVRGNEAQVVHFQNGRCTTEGMLLGTTTLNINSICGLRGLSVSQASVRGAPALTEEMPPLEDEVADGAAATYTLTRAADTALWLRVEEPDGRPYDIFGDQPAPLGTPDFTAVIVGTAIRPRTTSGAYLHDAYVDTTPGDADFTPSTGNTKIVLRGGGSGHVGQGHYWQFKPIAVEGGGSRPQYQEYNLPDYAGPTASNHDLAPPVAPRMPGELLLLFESDMPVWDNGAGAAPAQKIHCLLPNEFITHLFDLQAPALAEAALLRYVHPDSGRTLFECKLYREGYMVVAAPVGRLNFPLDGYFRFDSWVSAFYVLSPVGSGQGRR

SEQ ID NO: 2366 - protein, 572 aa, Artificial Sequence
  VP1__Norovirus_and/or_Norovirus-like__JF781268
MKMASSDATPSSDGAGNLVPESQQEVLPLAPVAGAALAAPVVGQQNIIDPWIKENFVQAPQGEFTVSPKNSPGEVLVNLELSPRLNPYLDHLSKMYNAYAGGMEVEIILAGNAFTAGKVLIAAVPPNFPIENISASQASQFPHVIVDVRTLEPIRLPLPDVRTNFFHYTTQEEPRMRIVAWLYTPLRTNGSGDDSFTVSGRILTRPSPDFEFSFLVPPTVETKTVSFSVPGLVVEDMSNSRWPAQINGLVVRGNEAQVVHFQNGRCTTEGTLLGTTTLSINSICGLRGLSVSQASVRGAPALTEEMPPLEDEVADGAAATYTLARAADTTLWLRVEEPDGRPYDIFGDQPAPLGTPDFTAVIVGTAIRPRTASGAYLHDAYVDTTPGDADFTPSTGNTKIVLRGGGSGHVGQGHYWQFRPIAVEGGGSRPQYQEYNLPDYAGPTASNHDLAPPVAPRMPGELLLLFESDMPVWDNGAGAAPAQKIHCLLPNEFITHLFDLQAPALAEAALLRYVHPDSGRTLFECKLYREGYMVVAAPAGRLNFPLDGYFRFDSWVSAFYILSPVGSGQGRR

SEQ ID NO: 2367 - protein, 565 aa, Artificial Sequence
  VP1__Norovirus_and/or_Norovirus-like__KT245136
MKMASNGAAAPSQDGAANLVPESQQEVLALEPVAGAALAAPVAGQFNAIDPWIKQNFVQAPAGEFTVSPRNAPGEVLMDLELGPEMNPFLAHLAQMYNAYAGGMEVQIILAGNAFTAGKIIVCAVPPNFPPDRLSASQATNFPHVIMDVRTLEPVVLPLPDVRAGFFHYNQLREPRMRLMTLLYTPLRANGTGDDAFTVSCRVLTRPMLDFEFMFLVPPTVESRVTPFSVPTYPVVEMTNSRWPARISGMHVNANQTLAVQFQNGRCTLDGQLMGTTQLCAADVCRMRGRYTSTRADPAGLGWDLDATTLVDGPEARVQARISVSAHLQLEELSGQPYEVYGEQPAPLGTPDFQCRLMGELVRLPSANPVAQSRFRDAFFDTYGALFAPAVGSVTVTVNNSSSSDFANDQPFEFLPIGVEIGNSARYDEFALPSYNGAIGENRHLAPIAAPGFPGENLIFFSSNLPVWDSTSAQSNRRISCLLPNEFIQHFYDLQAPSQSDVALLRYVHPETDRFLFECKLYRDAFLTVNGASYAEFPVNGYSRFDSWVKQFFTLSPVGTGSGRR

SEQ ID NO: 2368 - protein, 552 aa, Artificial Sequence
  VP1__Norovirus_and/or_Norovirus-like__AJ844470
MKMASKDASPSTDGAANLVPESQQEVLALQPVAGAQIAAPVAGQFNVIDPWIYQNFVQAPEGEFTVSPRNSTGEILMNLELGPQLNPYLAHLARMYNAYAGGFEVQVLLAGNAFTAGKIIVCAVPPNFPLQNISAAQATQLPHVVVDVRQLEPVVLPLPDVRAGFYHYNQVEESRMRLVAILYTPLRTNSAGDDAFTVSCRILTRPAPDFSFFFLIPPTIESKTTPFTLPRLPISEMTNSRFPLVIKGMVVDPNLPLQANFQNGRITLDGELQGTTLPTSTSIGRISGTYMSSTPSRIIQHEDSGDSTQPRVFNPVWMDLTENNWTEFQPFNDQPAPLGCPDFKAKILGTLIRQPNNGSYYFDAYLDTRQHGTFAPYTGHAAVHSDQQAGHLAQGYKIQFSPTGIESDQNTDLNQLPDYGGAMTVSKGLAPAAAPDFPGEMILYFVSDMPVRNPNGERRDTEILCLLPQEMVTHFYEQQAPSQGDVALVRYINAETGRVMFEGKLHRNGFFTVSATARTLIVPDGYFRFDSWVNRFYTLSPMGTGNGRRRAR

SEQ ID NO: 2369 - protein, 552 aa, Artificial Sequence
  VP1__Norovirus_and/or_Norovirus-like__KJ196291
MKMASKDASPSTDGTANLVPESQQEVLALQPVAGAQIAAPVAGQFNVIDPWIYQNFVQAPEGEFTVSPRNSTGEILMNLELGPQLNPYLAHLARMYNAYAGGFEVQVLLAGNAFTAGKIIVCAVPPNFPLQNISAAQATQLPHVVVDVRQLEPVVLPLPDVRAGFYHYNQVEESRMRLVAILYTPLRTNSAGDDAFTVSCRILTRPAPDFSFFFLIPPTIESKTTPFTLPRLPISEMTNSRFPLVIKGMVVDPNLPLQANFQNGRITLDGELQGTTLPTSTSIGRISGTHMSSTPSRIIQHEDSGDSTQPRVFNPVWMDLTENNWTEFQPFNDQPAPLGCPDFKAKILGTLIRQPNNGSYYFDAYLDTRQHGTFAPYTGHAAVHSDQQAGHLAQGYKIQFSPTGIESDQNTDLNQLPDYGGAMTVSKGLAPAAAPDFPGEMILYFVSDMPVRNPNGERRDTEILCLLPQEMVTHFYEQQAPSQGDVALVRYINAETGRVMFEGKLHRNGFFTVSATARTLIVPDGYFRFDSWVNRFYTLSPMGTGNGRRRAR

SEQ ID NO: 2370 - protein, 550 aa, Artificial Sequence
  VP1__Norovirus_and/or_Norovirus-like__KU870455
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQNARAADLTDSPQRARDHPLHVQVKNLDGTQYDPTDDIPAVLGAIDFKGTVFGVASQRDVSGTQEQGHYATRAHEAHIDTTDPKYAPKLGTILIKSESTDFTTNQPIRFTPVGMGDNNWRQWELPDYSGSLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2371 - protein, 550 aa, Artificial Sequence
  VP1__Norovirus_and/or_Norovirus-like__AF414408
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVKQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTGSPQRARNHPLHVQVKNLDGTQYDPTDDIPAVLGAIDFKGTVFGVASQRDVSGQQEQGHYATRAHEAHIDTTDPKYAPKLGTILIKSDSDDFNTNQPIRFTPVGMGDNNWRQWELPDYSGHLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2372 - protein, 550 aa, Artificial Sequence
  VP1__Norovirus_and/or_Norovirus-like__AB084071
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGPQEQGHYATRAHETHIDTTDPKYAPKLGTILIKSESNDFITNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2373 - protein, 550 aa, Artificial Sequence
  VP1__Norovirus_and/or_Norovirus-like__AF414407
MKMASNDAAPSNDGAANLVPEANNEVMALEPVVGASIAAPAVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPTLTLGELSNPRFPAAIDMLYTDPNESIVVQPQNGRCTLDGTLQGTTQLVPTQICAFRGTLISQTARAADSTDSPQRARNHPLHVQVKNLDGTQYDPTDDIPAVLGAIDFKGTVFGVASQRDVSGQQEQGHYATRAHEAHIDTTDPKYAPKLGTILIKSDSDDFNTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2374 - protein, 550 aa, Artificial Sequence
  VP1__Norovirus_and/or_Norovirus-like__AB039777
MKMASNDAAPSNDGAANLVPEANNEVMALEPVVGASIAAPVVGQQNIIDPWIRENFVQAPQGEFTVSPRNSPGEMLLNLELGPELNPYLSHLSPMYNGYAGGMQVQVVLAGNAFTAGKIIFAAVPPHFPVDNISAAQITMCPHVIVDVRQLEPVPLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLGGTQYDPTDDIPAVLGAIDFKGTVFGVASQRDVSGPQEQGHYATRAHEAHIDTTDPKYAPKLGTILIKSESNDFTTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2375 - protein, 550 aa, Artificial Sequence
  VP1__Norovirus_and/or_Norovirus-like__AB078337
MKMASNDAAPSNDGAANLVPEANDEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARNHPLHVQVKNLDGTQYDPTDDIPAVLGAIDFKGTVFGVASQRDVSGQQEQGHYATRAHEAHIDTTDPKYAPKLGTILIKSGSDDFNTNQPIRFTPVGMGDNNWRQWELPDYSGRLTLNMNLAPAVSPSFPGERILFFRSIVPSAGGYGSGYIDCLIPQEWVQHFYQEAAPSQSAVALVRYVNPDTGRNIFEAKLHREGFLTVANCGNNPIVVPPNGYFRFEAWGNQFYTLAPMGSGQGRRRAQ

SEQ ID NO: 2376 - protein, 550 aa, Artificial Sequence
  VP1__Norovirus_and/or_Norovirus-like__AB039776
MKMASNDAAPSNDGAANLVPEANNEVMALEPVVGASIAAPVVGQQNIIDPWIRENFVQAPQGEFTVSPRNSPGEMLLNLELGPELNPYLSHLSPMYNGYAGGMQVQVVLAGNAFTAGKIIFAAVPPHFPVDNISAAQITMCPHVIVDVRQLEPVPLPLPDIRNRFFHYNQENTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQTARAADSTDSPQRARDHPLHVQVKNLDGTQYDPTDDIPAVLGAIDFKGTVFGVASQRDVSGPQEQGHYATRAHEAHIDTTDPKYAPKLGTILIKSESNDFTTNQPIRFTPVGMGDNNWRQWELPDYSGRLALNMNLAPAVSPSFPGERILFFRSIVPSAGGYGSGYIDYLIPQEWVQHFYQEAAPSQSAVALVRYVNPDTGRNIFEAKLHREGFLTVANSGNNPIVVPPNGYFRFEAWVNQFYTLAPMGSGQGRRRAQ

SEQ ID NO: 2377 - protein, 550 aa, Artificial Sequence
  VP1__Norovirus_and/or_Norovirus-like__KT030674
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGERHTDIQYQEYELPDYSGQVASNHNLAPPVAPRMPGESLLLFQSNMPVWDDGRGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2378 - protein, 550 aa, Artificial Sequence
  VP1__Norovirus_and/or_Norovirus-like__DQ093067
MKMASNDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVVIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGEGHTNIQYQEYELPDYSGQVASNHNLAPPVAPRMPGESLLLFQSSMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2379 - protein, 550 aa, Artificial Sequence
  VP1__Norovirus_and/or_Norovirus-like__AF195847
MKMASSDAAPSADGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASPEADERAVGSFDVWIRLQEPDGQPYDIFGKQPAPIGTPDFKAVIVGFAARPLTSGSYANEAYVNTTASDYAPATGNMRFTVRNGGSGHISANKYWEFKSFGVEGERHTDIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2380 - protein, 550 aa, Artificial Sequence
  VP1__Norovirus_and/or_Norovirus-like__JQ970479
MKMASSDAAPSADGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWIRLQEPDGQPYDIFGKQPAPIGTPDFKAVIVGFAARPLTSGSYANEAYVNTTASDYAPATGNMRFTVRNGGTGHISANKYWEFRSFGVEGERHTDVQYQEYELPDYSGQVASNHNLAPPVAPRMPGESLLLFQSNMPVWDDGRGESTPKKIHCLLPQEFIGHFFDKQAPSLGDAALLRYVNQETNRVLFECKLYRDGYITVAAASGLLDFPLDGFFRFDSWVSSFYILSPVGSGQGRR

SEQ ID NO: 2381 - protein, 550 aa, Artificial Sequence
  VP1__Norovirus_and/or_Norovirus-like__FM865412
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGERHTNIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2382 - protein, 550 aa, Artificial Sequence
  VP1__Norovirus_and/or_Norovirus-like__AF414426
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGKRHTSIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2383 - protein, 550 aa, Artificial Sequence
  VP1__Norovirus_and/or_Norovirus-like__AF414427
MKMASSDAAPSADGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASTEADERAVGSFDVWIRLQEPDGQPYDIFGKQPAPIGTPDFKAVIVGFAARPLTSGSYANEAYVNTTASDYAPATGNMRFTVRNGGSGHISANKYWEFKSFGVEGERHTDIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2384 - protein, 550 aa, Artificial Sequence
  VP1__Norovirus_and/or_Norovirus-like__JQ613567
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEGVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASSEADERAVGSFDVWVRLQEPDGQPYDIFGKQPAPIGTPDFKAVIVGFAARPLTSGSYANEAYVNTTASDYAPATGNMRFTVRNGGTGHISANKYWEFKSFGVEGERHTDIQYQEYELPDYSGQVASNHNLAPPVAPRMPGESLLLFQSNMPVWDDGHGESTPKKIHCLLPQEFIGHFFDRQAPSLGDAALLRYVNQETNRVLFECKLYRDGYITVAASSGLLDFPLDGFFRFDSWVSSFYILSPVGSGQGRR

SEQ ID NO: 2385 - protein, 550 aa, Artificial Sequence
  VP1__Norovirus_and/or_Norovirus-like__KC894731
MKMASSDAAPSTDGAGNLVPESQQEVLPLAPVAGAALAAPVVGQTNIIDPWIKENFVQAPQGEFTVSPKNSPGEILVNLELGPKLNPYLDHLSRMYNSYAGGIDVMVVLAGNAFTAGKVLIAAIPPNFPVEVVSASQATQFPHVIIDVRTLDPVRLPLPDVRSTFFHYTNDTEPKMRLVIWLYTPLRTNGSGDDSFTVSGRILTRPSQDFEFAFLIPPTVETKTTPFSVPGFSVQEMSNSRWPAAISAMVVRGNEPQVVQFQNGRAHLDGMLLGTTPVSPNYIASYRGISTGNSRSASPEADERAVGSFDVWVRLQEPDGQPYDIFGKQPAPIGTPDFKAVIVGFAARPLTSGSYANEAYVNTTASNYAPATGNMRFTVRNGGTGHTSANKYWEFKSFGVEGERHTGIQYQEYELPDYSGQVASNHNLAPPVAPRMPGESLLLFQSNMPVWDDGHGESTPKKIHCLLPQEFIGHFFDKQAPSLGDAALLRYVNQETNRVLFECKLYRDGYITVAASSGLLDFPLDGFFRFDSWVSSFYILSPVGSGQGRR

SEQ ID NO: 2386 - protein, 548 aa, Artificial Sequence
  VP1__Norovirus_and/or_Norovirus-like__AF427118
MKMASNDAAPSSDGAAGLVPESNNEVMALEPVAGASLAAPVTGQTNIIDPWIRMNFVQAPNGEFTVSPRNSPGEVLLNLELGPELNPYLAHLSRMYNGYAGGMEVQIMLAGNAFTAGKLIFAAVPPHFPIENLSPPQITMFPHVIIDVRTLEPVLLPMPDIRNSFFHFIQRDEPKMRLVAMLYTPLRSNGSGDDVFTVSCRVLTRPTPDFDFTYLVPPTVESKSKPFTLPILTLGELTNSRFPLPIDVLYTNPNESAIVQCQNGRCTLDGELQGTTQLLPTGICAFRGKVTQQVQDEHRGTHWNMTVTNLNGTPFDPTEDVPAPLGTPDFSGQIYGVISQRNTNTVPGEGDLPANRAHEAVIATYSPKFTPKLGNIQFSTWETQDVSSGQPTKFTPVGLASVDANSHFDQWTLPSYSGALTLNMNLAPSVAPVFPGECLLFFRSFIPLKGGYGNPAIDCLMPQEWVQHLYQESAPSLSDVALVRYVNPETGRTLFEAKLHRNGFLTVARNSAGPVVAPTNGYFRFDSWVNQFYTLAPMGNGSGRRRMQ

SEQ ID NO: 2387 - protein, 548 aa, Artificial Sequence
  VP1__Norovirus_and/or_Norovirus-like__AY237415
MKMASNDAAPSSDGAAGLVPESNNEVMALEPVAGASLAAPVTGQTNIIDPWIRMNFVQAPNGEFTVSPRNSPGEVLLNLELGPELNPYLAHLSRMYNGYAGGMEVQIMLAGNAFTAGKLIFAAVPPHFPIENLSPPQITMFPHVIIDVRTLEPVLLPMPDIRNSFFHFIQRDEPKMRLVAMLYTPLRSNGSGDDVFTVSCRVLTRPTPDFDFTYLVPPTVESKSKPFTLPILTLGELTNSRFPLPIDVLYTNPNESAIVQCQNGRCTLDGELQGTTQLLPTGICAFRGKVTQQVQDEHRGTHWNMTVTNLNGTPFDPTEDVPAPLGTPDFSGQIYGVISQRNTNTVPGEGNLPANRAHEAVIATYSPKFTPKLGNIQFSTWETQDVSSGQPTKFTPVGLASVDANSHFDQWTLPSYSGALTLNMNLAPSVAPVFPGECLLFFRSFIPLKGGYGNPAIDCLMPQEWVQHLYQESAPSLSDVALVRYVNPETGRTLFEAKLHRNGFLTVARNSAGPVVAPTNGYFRFDSWVNQFYTLAPMGNGSGRRRMQ

SEQ ID NO: 2388 - protein, 548 aa, Artificial Sequence
  VP1__Norovirus_and/or_Norovirus-like__AF504671
MKMASNDAAPSNDGAAGLVPESNNEVMALEPVAGASLAAPVTGQTNIIDPWIRMNFVQAPNGEFTVSPRNSPGEVLLNLELGPELNPYLAHLSRMYNGYAGGMEVQIMLAGNAFTAGKLIFAAVPPHFPIENLSPPQITMFPHVIIDVRTLEPVLLPMPDIRNSFFHFIQRDEPKMRLVAMLYTPLRSNGSGDDVFTVSCRVLTRPTPDFDFTYLVPPTVESKSKPFTLPILTLGELTNSRFPLPIDVLYTNPNESAIVQCQNGRCTLDGELQGTTQLLPTGICAFRGKVTQQVQDEHRGTHWNMTVTNLNGTPFDPTEDVPAPLGTPDFSGQIYGVISQRNTNTVPGEGNLPANRAHEAVIATYSPKFTPKLGNIQFSTWETQDVSSGQPTKFTPVGLASVDANSHFDQWTLPSYSGALTLNMNLAPSVAPVFPGECLLFFRSFIPLKGGYGNPAIDCLMPQEWVQHLYQESAPSLSDVALVRYVNPETGRTLFEAKLHRNGFLTVARNSAGPVVAPTNGYFRFDSWVNQFYTLAPMGNGSGRRRMQ

SEQ ID NO: 2389 - protein, 548 aa, Artificial Sequence
  VP1__Norovirus_and/or_Norovirus-like__KJ194504
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLVAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRASDQADTPTPRQFDHRWHIQLDNLNGTPYDPAEDIPAPLGTPDFRGKVFGVASQRNPDGTTRAHEAKVDTTTNRFTPKLGSLEIITESEDFDTNQSTKFTPVGVGVDNEEEFQQWSLPNYSGQFTHNMNLAPAVAPNFPGEQLLFFRSQLPSSGGWSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2390 - protein, 548 aa, Artificial Sequence
  VP1__Norovirus_and/or_Norovirus-like__KJ194500
MKMASNDAAPSNDGAAGLVPEINNEAMALEPVAGAAIAAPLTGQQNIIDPWIMNNFVQAPGGEFTVSPRNSPGEVLLSLELGPEINPYLAHLARMYNGYAGGFEVQVVLAGNAFTAGKIIFAAIPPNFPIDNLSAAQITMCPHVIVDVRQLEPVNLPMPDVRNNFFHYNQSSESRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTGSTSRASDQTDTPTPRQFDRRWHIQLDNLNGTPYDPAEDIPAPLGTPDFRGKVFGVASQRNPDRATRAHEAKVDTTSDRFAPKLGSLEITTESGDFEANQPTKFTPVGIGVDNEAEFQQWSLPNYSGQITHNMNLAPAVAPNFPGEQLLFFRSQLPSSGGWSNGVLDCLLPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2391 - protein, 548 aa, Artificial Sequence
  VP1__Norovirus_and/or_Norovirus-like__DQ093063
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTESVVVQCQNGRVTLDGELMGTTQLLPSQICAFRGTLTRPTNRASDQADTATPRLFNHQWHIQLDNLNGTPYDPAEDIPAPLGTPDFRGKVFGVASQRDPDGTTRAHEAKVDTTSGRFTPKLGSLEITTESDDFNQNKPTRFTPVGIGVDNEADFQQWILPDYSGQFTHNMNLAPAVAPNFPGEQLLFFRSQLPSSGGRSNGILDCLVPQEWVQHFYQESAPAQTQVALVRYVNPDTGRVLFEAKLHKMGFMTIAKNGDSPITVPPNGYFRFESWVNPFYTLAPMGTGKGRRRIQ

SEQ ID NO: 2392 - protein, 548 aa, Artificial Sequence
  VP1__Norovirus_and/or_Norovirus-like__AY030313
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTESIVVQCQNGRVTLDGELMGTTQLLPNQICAFRGTLTRSTNRASDQADTATPRLFDHHWHIQLDNLNGTPYDPAEDIPAPLGTPDFRGKVFGVASQRNPDSTTRAHEAKVDTTSGRFTPKLGSLEITTESDDFDPNQSTKFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2393 - protein, 548 aa, Artificial Sequence
  VP1__Norovirus_and/or_Norovirus-like__U02030
MKMASNDAAPSNDGAACLVPEINNEAMALEPVAGSAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGTLTRSTSRASDQADTPTPRLFNYYWHIQLDNLNGTPYDPAEDIPAPLGTPDFRGKVFGVASQRNPDSTTRAHEAKVDTTSGRFTPKLGSLEITTESDDFDPNQPTKFTPVGVGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2394 - protein, 548 aa, Artificial Sequence
  VP1__Norovirus_and/or_Norovirus-like__AB039782
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNHRWHIQLDNLNGTPYDPAEDIPAPLGTPDFRGKVFGVASQRNPDSTTRAHEAKVDTTSGRFTPKLGSLEITTESDDFDTNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2395 - protein, 548 aa, Artificial Sequence
  VP1__Norovirus_and/or_Norovirus-like__U46039
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLFTPLRANNSGDDVFTVSCRVLTRPSPDFSFNFLVPPTVESKIKPFTLPILPISEMSNSRFPVPIDSLHTSPTENIVVQCQNGRVTLDGELMGTTQLFPSQICAFRGTLTRSTSRASDQADTSTPRLFNYYWHIQLDNLNGTPYDPAEDIPAPLGTPDFQGKVFGVASQRNPDSTTRAHEAKVDTTSGRFTPKLGSLEISTESDDFDSNQPTKFTPVGIGVDNEADFQQWSLPNYSGQFTHNMNLAPAVAPIFPGEQILFFRSQVPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2396 - protein, 548 aa, Artificial Sequence
  VP1__Norovirus_and/or_Norovirus-like__DQ093066
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICTFRGTLTRSTSRASDQADTATPRLFNYYWHIQLDNLNGTPYDPAEDIPAPLGTPDFRGKVFGVASQRNPDSTTRAHEAKVDTTSGRFIPKLGSLEISTESDDFDQNQPTRFTPVGIGVDNEAGFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTISKNGDSPITVPPNGYFRFESWVNPFYTLAPMGTGNGRRRIQ

SEQ ID NO: 2397 - protein, 548 aa, Artificial Sequence
  VP1__Norovirus_and/or_Norovirus-like__DQ093062
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRPTSRASDQADTPTPRLFNHRWHIQLDNLNGTPYDPAEDIPAPLGTPDFRGKVFGVASQRNPDSTTRAHEAKVDTTSGRFTPKLGSLEITTESDDFDTNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVKYVNPDTGRVLFEAKLHKLGFMTIAKNGDSPITVPPNGYFRFESWVNPFYTLAPMGTGNGRRRIQ

SEQ ID NO: 2398 - protein, 548 aa, Artificial Sequence
  VP1__Norovirus_and/or_Norovirus-like__GU930737
MKMASNDAAPSNDGAANLVPEANSEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSEEGATRAHEVHIDTTNPRYTPKLGSVFMHSESTDFDDGQPTRFTPIGMGADDWRQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2399 - protein, 548 aa, Artificial Sequence
  VP1__Norovirus_and/or_Norovirus-like__AF414412
MKMASNDAAPSSDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNYYWHIQLDNLNGTPYDPAEDIPAPLGTPDFRGKVFGVASQRNPDSTTRAHEAKVDTTSGRFTPKLGSLEISTESDDFDPNQPTKFTPVGIGVDNEADFQQWSLPNYSGQFTHNMNLAPAVAPNFPGEQLLFFRSQRPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2400 - protein, 548 aa, Artificial Sequence
  VP1__Norovirus_and/or_Norovirus-like__AB039781
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGATQLLPSQICAFRGTLTRSTSRASDQTDTPTPRLFNHRWHIQLDNLNGTPYDPAEDIPAPLGTPDFRGKVFGVASQRNPDSTTRAHEAKVDTTSGRFTPKLGSLEITTESDDLDTNQSTKFTPVGIGVDNEAEFQQWSLPNYSGQFTHNMNLAPAVALNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2401 - protein, 548 aa, Artificial Sequence
  VP1__Norovirus_and/or_Norovirus-like__LC035073
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTSGRFTPKLGSLEISTESDDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 2402 - protein, 548 aa, Artificial Sequence
  VP1__Norovirus_and/or_Norovirus-like__AF539440
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESDDFDQNQPTRFTPVGVGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2403 - protein, 548 aa, Artificial Sequence
  VP1__Norovirus_and/or_Norovirus-like__AF414414
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNHRWHIQLDNLNGTPYDPAEDIPAPLGTPDFRGKVFGVASQRNPDSTTRAHEAKVDTTSGRFTPKLGSLEIITESDDFDTNQSTKFTPVGIGVDNESEFQQWSLPNYSGQFTHNMNLAPAVAPNFLGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2404 - protein, 548 aa, Artificial Sequence
  VP1__Norovirus_and/or_Norovirus-like__AB190457
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2405 - protein, 548 aa, Artificial Sequence
  VP1__Norovirus_and/or_Norovirus-like__AF425768
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLSGTPYDPAEDIPGPLGTPDFRGKVFGVASQRNPDSTTRAHEAKVDTTAGRFTPKLGSLEISTESDDFDQNQPTRFTPVGVGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2406 - protein, 548 aa, Artificial Sequence
  VP1__Norovirus_and/or_Norovirus-like__AF414415
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQAVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNHRWHIQLDNLNGTPYDPAEDIPAPLGTPDFRGKVFGVASQRNPDSTTRAHEAKVDTTSDRFTPKLGSLEIITESGDFDTNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2407 - protein, 548 aa, Artificial Sequence
  VP1__Norovirus_and/or_Norovirus-like__KT779557
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPTDNLSAAQITMCPHVIVDVRQLEPINLPMPDVRNNFFHYNQGSDSRLRLIAMLYTPLRANNSGDDVFTVSCRVLTRPSPDFSFNFLVPPTVESKIKPFTLPILTISEMSNSRFPVPIDSLHTSPTDNIVVQCQNGRVTLDGELMGTTQLLPSQICAFRGVLTRSTSRASDQADAATPRLFNYHWHIQLDNLNGTPYDPAEDIPAPLGTPDFRGKVFGVASQRNPDSTTRAHEAKVDTTSGRFTPKLGSLEISTESGDFDQNQPIRFTPVGIGVDNEADFQQWTLPDYSGQFTHNTNLAPAVAPNFPGEQLLFFRSQLPSSGGRSNGILDCLVPQEWVQHFYQESAPAQTQVALVRYVNPDTGRVLFEAKLHKLGYMTIAKSGDSPITVPPNGYFRFESWVNPFYTLAPMGTGNGRRRIQ

SEQ ID NO: 2408 - protein, 548 aa, Artificial Sequence
  VP1__Norovirus_and/or_Norovirus-like__AY247432
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPNGNFVVQCQNGRVTLDGELMGTTQLLPSQICAFRGVLTRQVSRAGDQIDTATPRSFGNHWHIQLDNLNGTPYDPAEDIPGPLGTPDFQGIVFGVASQRNSDGTTRAHEAKVDTRTGRFTPKLGSLVISTDSEDFQQNKPTRFTPVGVGVDSEEEFDQWSLPDYSGPITHNMNLAPAVAPNFPGEQLLFFRSQLPSSGGISKGILDCLVPQEWVQHFYQESAPAQTQVALVRYVNPDTGRVLFEAKLHKLGFMTIAKDGDSPITVPPNGYFRFESWVNPFYTLAPMGTGNGRRRIQ

SEQ ID NO: 2409 - protein, 548 aa, Artificial Sequence
  VP1__Norovirus_and/or_Norovirus-like__AF414411
MKMASNDAAPSNDGAAGLVPEINNEAMALEPVAGAAIAAPLTGQQNIIDPWIMNNFVQAPGGEFTVSPRNSPGEVLLNLELGLEINPYLAHLARMYNGYAGVFEVQVVLAGNAFTAGKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKLFTLPILTISEMSNSRFPVPIDSLHTSPTKNIVVQCQNGRVTLDGELMGTTQLLPSQICAFRGTLTRSTSRASDQADTPTPRLFGHRWHIQLDNLNGTPYDPAEDIPAPLGTPDFRGKVFGVASQRNPDSTTRAHEAKVDTTSGRFTPKLGSLEIITESDDFDTNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2410 - protein, 548 aa, Artificial Sequence
  VP1__Norovirus_and/or_Norovirus-like__AJ277617
MKMASNDAAPSNDGAAGLVPEINNEAMALEPVAGAAIAAPLTGQQNIIDPWIMNNFAQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDEVFTVSCRVLTRPSPDFSFNFLVPPTVESKTKLFTLPILTISEMSNSRFPVPIDSLHTSPTENIVVQCQNGRVTLDGELMGTTQLLPSQICAFRGTLTRSTSRASDQADTPTPRLFNHRWHIQLDNLNGTPYDPAEDIPAPLGTPDFRGKVFGVASQRNPDSTTRAHEAKADTTSGRFTPKLGSLEIITESDDFDTNQSTKFTPVGIGVDNEAEFQQWSLPNYSGQFTHNMNLAPAVAPNFPGEQLLFFRSQLPSSGGRSNGVLDCLIPQEWVQHFYQESAPAQTQVALVRYVNPDTGRVLFEAKLHKLGFMTIAKNGDSPITVPPNGYLRFESWVNPFYTLAPMGTGNGRRRIQ

SEQ ID NO: 2411 - protein, 548 aa, Artificial Sequence
  VP1__Norovirus_and/or_Norovirus-like__LC036561
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTSGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 2412 - protein, 548 aa, Artificial Sequence
  VP1__Norovirus_and/or_Norovirus-like__KT732274
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLVAMLYTPLRANNSGDDVFTVSCRVLTRPSPEFSFNFLVPPTVESKTKLFTLPILTISEMSNSRFPVPIDSLHTSPTENIVVQCQNGRVTLDGELMGTTQLLPSQICAFRGVLTRSTSRASDQADTATPRLFNYYWHIQLDNLNGTPYDPAEDIPGPLGTPDFRGKVFGVASQRNPDSTTRAHEAKVDTTSGRFTPKLGSLEISTESGDFDQNQPTRFTPVGIGVDSEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRVQ

SEQ ID NO: 2413 - protein, 548 aa, Artificial Sequence
  VP1__Norovirus_and/or_Norovirus-like__AY247439
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPNNNFVVQCQNGRVTLDGELMGTTQLLPSQICAFRGVLARQINRAGDQIDTTTPRSFDHHWHIQLDNLNGTPYDPAEDIPGPLGTPGFKGIVFGVASQRNSDGTTRAHEAKVDTRTGRFTPKLGSLVISTDSEDSQQNKPTRFTPVGVGVDNEEEFDQWSLPNYSGPITHNMNLAPAVAPNFPGEQLLFFRSQLPSSGGTSKGILDCLVPQEWVQHFYQESAPAQTQVALVRYVNPDTGRVLFEAKLHKLGFMTIAKDGDSPITVPPNGYFRFESWVNPFYTLAPMGTGNGRRRIQ

SEQ ID NO: 2414 - protein, 548 aa, Artificial Sequence
  VP1__Norovirus_and/or_Norovirus-like__AF539439
MKMASSDATPSNDGAAGLVPEINNEAMALDPVAGAAIAAPLTGQQNIIDPWIMNNFVQAPGGEFTVSPRNSPGELLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRASDQADTPTPRLFNYYWHIQLDNLNGTPYDPAEDIPGPLGTPDFRGKVFGVASQRNPDSTTRAHEAKVDTTAGRFTPKLGSLEISTESGDFDQNQPTRFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2415 - protein, 548 aa, Artificial Sequence
  VP1__Norovirus_and/or_Norovirus-like__AF414413
MKMASNDAAPSNDGAAGLVPEINNEAMALEPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPIDNLSAAQITMCPHVIVDVRQLEPINLPMPDVRNNFFHYNQGSDSRLRLIAMLYTPLRANNSGDGVFTVSCRVLTRPSPDFSFNFLVPPTVESKTRLFTLPILTISEMSNSRFPVPIDSLHTSPTENIVVQCQNGRVTLDGELMGTTQLLPSQICAFRGTLTRSTSRASDQADTPIPRLFNHRWHIQLDNLNGTPYDPAEDIPAPLGTPDFRGKVFGVASQRNPDSTTRAHEAKVDATPGRFTPKLGSLEIITESDDFDTNQSTKFTPVGIGVDNEAEFQQWSLPNYSGQFTHNMNLAPAVAPNFPGEQLLFFRSQLPSSGGRSNGVLDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2416 - protein, 548 aa, Artificial Sequence
  VP1__Norovirus_and/or_Norovirus-like__AF427112
MKMASNDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTRPTENIVVQCQNGRVTLDGELMGTTQLLPSQICAFRGVLTRSTSRASDQADTATPRLFNYYWHIQLDNLNGTPCDPAEDIPGPLGTPDFRGKVFGVASQRNPDSTTGAHEAKVDTTAGRFTPKLGSLEISTESGDFDQNQPTKFTPVGIGVDHEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2417 - protein, 548 aa, Artificial Sequence
  VP1__Norovirus_and/or_Norovirus-like__AF190817
MKMASNDATPSNDGAAGLVPEINNEAMALDPVAGAAIAAPLTGQQNIIDPWIMNNFVQAPGGEFTVSPRNPPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIESLHTGPTENIVVQCQNGRVTLDGELMGTTQLLPSQICAFRGVLTRSTSRASDQADTATPRLFNYYWHVQLDNLNGTPYDPAEDIPGPLGTPDFRGKVFGVASQRNPDSTTRAHEAKVDTTAGRFTPKLGSLEISTDSSDFDQNQPTRFTPVGIGVDNEADFQQWSLPDYSGQFTHNMNLAPAVAPNFPGEQLLFFRSQLPSSGGRSNGVLDCLVPQEWAQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2418 - protein, 548 aa, Artificial Sequence
  VP1__Norovirus_and/or_Norovirus-like__LC035072
MKMASNDATPSNDGAAGLVPEINNEAMALDPVAGAAIAAPLTGQQNVIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPEFSFNFLVPPTVESKTKPFTLPILTISEMSNSRFPVPIDSLHTSPTENIVVQCQNGRVTLDGELMGTTQLLPSQICAFRGVLTRSTSRASDQADTATPRLFNYYWHIQLDNPNGTPYDPAEDIPGPLGTPDFRGKVFGVASQRNPDSTTRAHEAKVDTTSGRFTPKLGSLEISTESDDFDQNQPTRFTPVGIGVDREADFQQWSLPDYSGQFTHNMNLAPAVAANSPGEQLIFFWSQSPYCGGRSNRVLDCMVPQEWVQHFYQESAPAQTQLALVRYVNPDTGRVLFEAKLHKLGFMTIAKNGDSPITVPPNGYFRFESWVNPFYTLAPMGTGNGRRRVQ

SEQ ID NO: 2419 - protein, 548 aa, Artificial Sequence
  VP1__Norovirus_and/or_Norovirus-like__DQ093064
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAAIDMLYADPNESIVVQPQNGRCTLDGTLQGTTQLVPTQICAFRGTLISQTARATDSTDSPQRARDHPLHVQVKNLDGTQYDPTDDIPAVLGAIDFKGTVFGVASQRDVSGPQEQGHYATRAHEAHIDTTDPKYAPKLGTILIKSESNDFITNQPIRFTPVGMGDNNWRQWELPDYSGRLTLNMNLAPAVSPSFPGERILFFRSIVPSAGGYGSGYIDCLIPQEWGQHFYQEAAPSQSAVALVRYVNPDTGRNIFEAKLHREGFLTVANSGNNPIVVPPNGYFRFEAWVNQFYTLAPMGSGQGRRR

SEQ ID NO: 2420 - protein, 548 aa, Artificial Sequence
  VP1__Norovirus_and/or_Norovirus-like__L23830
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAAKVIFAAIPPNFPIDNLSAAQITMCPHVIVDVRQLEPINLPMPDVRNNFFHYNQGSDSRLRLIAMLYTPLRANNSGDDVFTVSCRVLTRPSPDFSFNFLVPSTMESKTKPFTLPILTISEMSNSRFPVPIDSLHTSPTESIVVQCQNGRVTLDGELMGTTQLLPNQICAFRGTLTRSTNRASDQADTATPRLFNHHWHIQLDNLNGTPYDPAEDIPAPLGTPDFRGKVFGVAGQRNPDSTTRAHEAKVDTTSGRFTPKLGSLEITTESDDFDPNQSTKFTPVGIGVDNEADFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGTGNGRRRIQ

SEQ ID NO: 2421 - protein, 548 aa, Artificial Sequence
  VP1__Norovirus_and/or_Norovirus-like__KX907728
MKMASNDAPPSSDGAGNLVPESHQEVLPLAPVAGAELAAPVVGQTNIIDPWIKENFVQAPQGEFTVSPKNAPGEILVNLELGPNLNPYLEHLSRMYNAYAGGIEVEIILAGNAFTAGKILIAAVPPNFPVESVSASQATQFPHAIVDVRTLEPVRLPLPDVRSNFFHYTTKDEPKMRLVIWLYTPLRTNGSGDDSFTVSGRLLTRPSMDFQFSFLVPPTVETKTVLFTVPGLTPQEMSNSRWPAQISGMVVRGNEPQVVQFQNGRCHTDGTLLGTTTVSEQCIAGFVGTSTNTRSATGSTTETRTGDTDLWLRLEEPNGQPYDIFGDQPAPLGTPDFRAVIVGFASRPQTQGSYMNEAYVNTVDSHFAPATGNTKIILRRGGTGHVGGGHLWKFRPFGVEGGEGRVSYQEYVLPNYSGATASNHNLAPPVAPRMPGELLLLFESDMPVWDDGHGAAPAQKIHCLLPQQFITHFFDSQAPALAEAALLRYVHPDSSRVLFETKLYREGFMVVSAPTGRFDFPLDGYFRFDSWVNSFYVLSPVGSGQGRR

SEQ ID NO: 2422 - protein, 547 aa, Artificial Sequence
  VP1__Norovirus_and/or_Norovirus-like__AB039779
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTPRSADSTDSAPRVRNHPLHVQLKNLDGTPYDPTDEVPAVLGAIDFKGTVFGVASQRNTTGSSVGATRAHEVHIDTTNPRYTPKLGSVLMYSESSDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYALTPMGTGQGRRRVQ

SEQ ID NO: 2423 - protein, 547 aa, Artificial Sequence
  VP1__Norovirus_and/or_Norovirus-like__AB039778
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGSSVGATRAHEVHIDTTNPRYTPKLGSVLMYSESSDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2424 - protein, 547 aa, Artificial Sequence
  VP1__Norovirus_and/or_Norovirus-like__KY424345
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEGIVVQPQNGRCTLDGTLQGTTQLVPTQICAFRGTLIGQTSRSSDSTDSAPRRRDHPLHVQLKNLDGTQYDPTDEVPAVLGAIDFKGAVFGVASQRDVSGTQVGATRAHEVHINTTDPRYTPKLGSILMHSESDDFVTGQPIQFTPVGMGDNDWHQWELPDYSGHLTLNMNLAPAVAPAFPGERILFFRSIVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRNQ

SEQ ID NO: 2425 - protein, 547 aa, Artificial Sequence
  VP1__Norovirus_and/or_Norovirus-like__HQ169542
MMMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLVSQTSRSADSTDSAPRVRNHPLHVQLKNLDGTPYDPTDEVPAVLGAIDFKGTVFGVASQRNTTGGSVGATRAHEVHIDTTNPRYTPKLGSVLMYSESSDFDDGQPTRFTPIGMGADDWRQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2426 - protein, 547 aa, Artificial Sequence
  VP1__Norovirus_and/or_Norovirus-like__KX228762
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVFGVASQRNTTGNSIGATRAHEVHIDTTNPRYTPKLGSVLMHSESNDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2427 - protein, 547 aa, Artificial Sequence
  VP1__Norovirus_and/or_Norovirus-like__AF414410
MKMASNDAAPSNDGAANLVPEANNEVMALEPVVGASIAAPVVGQQNIIDPWIRENFVQAPQGEFTVSPRNSPGEILLNLELGPELNPYLSHLSRMYNGYAGGMQVQVVLAGNAFTAGKIIFAAVPPHFPVENISAAQITMCPHVIVDVRQLEPVFLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNETIVVQPQNGRCTLDGTLQGTTQLVPTQICSFRGTLISQTSRSADSTDSAPRARNHPLHVQLKNLDGTPYDPTDEVPAVLGAIDFKGTVFGVASQRNTTGSSVGATRAHEVHIDTTDPRYTPKLGSVLMYSESNDFDDGQPTRFTPIGMGADDWHQWELPEYSGHLTLNMNLAPAVAPAFPGERILFFRSVVPSAGGYGSGQIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2428 - protein, 547 aa, Artificial Sequence
  VP1__Norovirus_and/or_Norovirus-like__KU935739
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRARNHPLHVQLKNLDGTPYDPTDEVPAVLGAIDFKGTVFGVASQRNTTGNSIGATRAHEVHIDTTNPRYTPKLGSVLMYSESNDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2429 - protein, 547 aa, Artificial Sequence
  VP1__Norovirus_and/or_Norovirus-like__KX268709
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRARNHPLHVQLKNLDGTPYDPTDEVPAVLGAIDFKGTVFGVASQRNTTGNSIGATRAHEVHIDTTNPRYTPKLGSVLMHSESTDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGTGQGRRRVQ

SEQ ID NO: 2430 - protein, 547 aa, Artificial Sequence
  VP1__Norovirus_and/or_Norovirus-like__KX158282
MKMASNDAAPSNDGAANLVPEATNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVENISAAQITMCPHVIVDVRQLEPVLLPLPDIRNRFFHYNQENTPRMRLVAMLYTPLRANSGEDVFTVSCRVLTRPAPDFEFTFLVPPTVESKTKPFTLPILTLGELSNSRFPAPIDMLYTDPNEAIVVQPQNGRCTLDGTLQGTTQLVPTQICSFRGTLISQTSRSADSTDSAPRVRNHPLHVQLKNLDGTPYDPTDEVPAVLGAIDFKGTVLGVASQRNTTGSSIGATRAHEVHIDTTNPRYTPKLGSVLMHSESTDFDDGQPTRFTPIGMGADDWHQWELPEYSGHLTLNMNLAPAVAPAFPGERILFFRSVVPSAGGYGSGHIDCLIPQEWVQHFYQEAAPSQSAVALIRYVNPDTGRNIFEAKLHREGFITVANSGNNPIVVPPNGYFRFEAWVNQFYTLTPMGIGQGRRRVQ

SEQ ID NO: 2431 - protein, 547 aa, Artificial Sequence
  VP1__Norovirus_and/or_Norovirus-like__AB126320
MKMASSDAAPSTDGSARLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTIGDGQPASHSEEEIMPMAFNIQREIMLENLDGTPYDPADDIPAVLGSPDFQGVIFGILSQRNTDGQTRAHEAKVDTRAARFAPKLGFVVATVESTDFHANQPSRFTPVGLGGDNNQDFNQWRLPAYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRAR

SEQ ID NO: 2432 - protein, 547 aa, Artificial Sequence
  VP1__Norovirus_and/or_Norovirus-like__AY077644
MKMASNDASPSADGSAGLVPEVNNETMALEPVVGAPLAAPVAGQHNIIDPWIKMNFVQAPNGEFTVSPRNAPGEILLDLELGPDLNPYLSHLARMYNGYAGGMEVQVVLAGNAFTAGKIIFAAVPPNFPAENLSAAQVTMCPHVIVDVRQLEPVMLPMPDIRNKLFHYNQVDDPKLRLLAYLYTPLRANNAGDDVFTVSCRVLTRPTPDFEFMFLVPPTVESKTKPFSLPSLTLDELSNSRFPAPIVQLYTNPHDNLVVQPQNGRCTIDGLLQGTTQLVSCNVCSFRGTLGDGQPASHSEEEIMPMAFNIQREIMLENLDGSPYDPTDDIPAVLGSPDFQGVVFGILSQRNTDGQTRAHEAKVDTRLARFAPKLGFVVATVENTDFHANQPCRFTPVGLGGDNNRDFNQWGLPAYGGALTNNTNLAPPVMPVYPGEQLLFFRSQLPSSGGVVGGWLDCLLPQEWVQHFFQESATSQSDVALVRYINPTTGRVLFEAKLHKQGFLTVAASGSYPLVVPADGYFRFESWVNQFYTLAPMGNGSGRRRVR

SEQ ID NO: 2433 - protein, 547 aa, Artificial Sequence
  VP1__Norovirus_and/or_Norovirus-like__AY823306
MKMASSDAAPSSDGSAGLVPEVNSETMALEPVVGAPLAAPVAGQHNIIDPWIKLNFVQAPNGEFTVSPRNAPGEILLDLELGPDLNPYLAHLSRMYNAYAGGMEVQVILAGNAFTAGKIIFAAVPPNFPLENLSAAQITMCPHIIVDVRQLEPVMLPMPDVRNRLFHYNQVREPRLRLVAYLYTPLRANNAGDDVFTVSCRVLTRPSQDFEFMFLVPPSVESKTKPFSLPNLTLAELSNSRFPLPIEQLYTNPLDNLVVQPQNGRCTIDGILLGTTQLVPSLICSMRGTLEADQASGHTDDESVQSRAFNRQRSLMLENPDGSAFDPSDEVPAVLGVPDFRGVVFGVLSQRNNGDTTRSHEAKIDTRRPRYAPKLGFVEVLTESDDFQNGPPTKFTPVGLGGDGNPDFQQWALPDYGGALTNNTNLAPPVVPVYPGEQILFFRSQLPSSGGTVAGWLDCLLPQEWIQHFYQDSAAAQSDVALVRYINPATGRVLFEAKLHRQGFLTVSAAGPHPVVAPADGYFRFESWVNQFYTLAPMGNGSGRRRV

SEQ ID NO: 2434 - protein, 545 aa, Artificial Sequence
  VP1__Norovirus_and/or_Norovirus-like__KF586508
MMMASKDATSNMDGTSGAGQLVPENNNTSEPINMEPVAGAVTAAATAGQVNMIDPWIMNNYVQAPQGEFTISPNNTPGDILFDLQLGPHLNPFLAHLSQMYNGWVGNMKVRVVLAGNAFSAGKIIVCCIPPGFSAPNISIAQATMFPHVIADVRVLEPIDIPLDDVRNVLFHNNDNGNQTMRLLCMLYTPLRSGGTSSGTDPFVIAGRVLTCPTPDFNFLFLVPPTVEQKTKQFSVPNLPLNVMSNSRVPSLLNAMVVSPDQAQVVQFQNGRCTLDGQMLGTTTVSASCVARFRGKTFQAPDNRLGINLAEISGEPYHAFESPAPLGFPDFGDGDWHVTATKVTPSQLEANDPVVMGNVQPYNPQFAPHLGTLVVENPTPDNVTTGTDLLFNITWLSNRANNRFNPWVIPNYGSTLTEAAQLAPSIFPPGFGETIVYFNSTFPAVGATTHAAIPCLLPQEFVAHFVNEQAPIRGEAALLHYIDPDTHRNLGEFKIYPEGFVTCVPNVGGTGPQSLPTNGIFVFVSWVSRYYQLKPVGTAGQARRL

SEQ ID NO: 2435 - protein, 545 aa, Artificial Sequence
  VP1__Norovirus_and/or_Norovirus-like__HQ637267
MMMASKDATSNMDGTSGAGQLVPENNNTSEPINMEPVAGAVTAAATAGQVNMIDPWIMNNYVQAPQGEFTISPNNTPGDILFDLQLGPHLNPFLAHLSQMYNGWVGNMKVRVVLAGNAFSAGKIIVCCIPPGFSAPNISIAQATMFPHVIADVRVLEPIDIPLDDVRNVLFHTNDNGNQTMRLLCMLYTPLRSGGTSSGTDPFVIAGRVLTCPTPDFNFLFLVPPTVEQKTKQFSVPNLPLNVMSNSRVPSLLNAMVVSPDQAQVVQFQNGRCTLDGQMLGTTTVSASCVARFRGKTFQAPDNRLGINLAEISGEPYHAFESPAPLGFPDFGDGDWHVTATKVTPSQLEANDPVVVGNVQPYNPQFAPHLGTLVVENPTPDQVATGTDLLFNITWLSNRANNRFNPWVIPNYGSTLTEAAQLAPSIFPPGFGETIVYFNSTFPAVGATTHAAIPCLLPQEFVAHFVNEQAPIRGEAALLHYIDPDTHRNLGEFKIYPEGFVTCVPNVGGTGPQSLPTNGVFVFVSWVSRYYQLKPVGTAGQARRL

SEQ ID NO: 2436 - protein, 542 aa, Artificial Sequence
  VP1__Norovirus_and/or_Norovirus-like__AY134748
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLQDNDHLYNITITNLNGSPFDPSEDIPAPLGVPDFQGRVFGVITQRDKQNAAGQSQPANRGHDAVVPTYTAQYTPKLGQVQIGTWQTDDLKVNQPVKFTPVGLNDTEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2437 - protein, 542 aa, Artificial Sequence
  VP1__Norovirus_and/or_Norovirus-like__AY054300
MKMASNDAAPSTDGAAGLVPESNSEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVPIDQMFTSPNEVISVQCQNGRCTLDGELQGTTQLQVSGICAFKGEVTAHLHDNDHLYNVTITNLNGSPFDPSEDIPAPLGVPDFQGRVFGVISQRDKQNAAGHSEPANRGHDAVVPTYTAQYTPKLGQIQIGTWQTDDLQVNQPVKFTPVGLNDTEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2438 - protein, 542 aa, Artificial Sequence
  VP1__Norovirus_and/or_Norovirus-like__KY485125
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEIISVQCQNGRCTLDGELQGTTQLQVSGICAFKGEVTAHLHDNDHLYNVTITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2439 - protein, 542 aa, Artificial Sequence
  VP1__Norovirus_and/or_Norovirus-like__KY485123
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGHAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2440 - protein, 542 aa, Artificial Sequence
  VP1__Norovirus_and/or_Norovirus-like__KY485126
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEIISVQCQNGRCTLDGELQGTTQLQVSGICAFKGEVTAHLHDNDHLYNVTITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNINLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2441 - protein, 542 aa, Artificial Sequence
  VP1__Norovirus_and/or_Norovirus-like__U70059
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICASKGEVTAHLQDNDHLYNITITNLNGSPFDPSEDIPAPLGVPDFQGRVFGVITQRDKQNAAGQSQPANRGHDAVVPTYTAQYTPKLGQVQIGTWQTDDLKVNQPVKFTPVGLNDTEHFNQWVVPRYAGALNLNTNLAPSVAPVFPGERLLFFRSYLPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2442 - protein, 542 aa, Artificial Sequence
  VP1__Norovirus_and/or_Norovirus-like__LC145808
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNAPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2443 - protein, 542 aa, Artificial Sequence
  VP1__Norovirus_and/or_Norovirus-like__LC145795
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTINQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2444 - protein, 542 aa, Artificial Sequence
  VP1__Norovirus_and/or_Norovirus-like__AB629941
MKMASNDAAPSTDGAAGLVPESNNEVMALEPVAGAALAAPVTGQTNIIDPWIRANFVQAPNGEFTVSPRNAPGEVLLNLELGPELNPYLAHLARLYNGYAGGMEVQVMLAGNAFTAGKLVFPAVPPHFPIENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVSQPVKFTPVGLNDIEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2445 - protein, 542 aa, Artificial Sequence
  VP1__Norovirus_and/or_Norovirus-like__LC145792
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVLPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2446 - protein, 542 aa, Artificial Sequence
  VP1__Norovirus_and/or_Norovirus-like__LC145786
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYSQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2447 - protein, 542 aa, Artificial Sequence
  VP1__Norovirus_and/or_Norovirus-like__LC145793
MKMASNDAAPSTDGAAGLVPESNNEVMALEPVAGVALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFEGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2448 - protein, 542 aa, Artificial Sequence
  VP1__Norovirus_and/or_Norovirus-like__LC145791
MKMASNDVAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2449 - protein, 542 aa, Artificial Sequence
  VP1__Norovirus_and/or_Norovirus-like__LC145788
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLAVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2450 - protein, 542 aa, Artificial Sequence
  VP1__Norovirus_and/or_Norovirus-like__LC145803
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSSFDPSEDIPAPLGIPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2451 - protein, 542 aa, Artificial Sequence
  VP1__Norovirus_and/or_Norovirus-like__LC145804
MKMASNDAAPSTDGAAGLVPESNSEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLAVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2452 - protein, 542 aa, Artificial Sequence
  VP1__Norovirus_and/or_Norovirus-like__LC145801
MKMASNDAAPSTDGAAGLVPESTNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGAPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2453 - protein, 542 aa, Artificial Sequence
  VP1__Norovirus_and/or_Norovirus-like__LC145802
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGHAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFEFTYLVPPTVESKTKPFTLPILTLGELSNSRFPVSIDQMYTSPNEVISVQCQNGRCTLDGELQGTTQLQASGICAFKGEVTAHLHDNDHLYNVTITNLNGSPFDPSEDIPAPLGVPDFQGRVFGVISQRDKHNAPGHNEPANRAHDAVVPTYTAQYTPKLGQIQIGTWQTDDLTVNQPVKFTPVGLNDTDHFDQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2454 - protein, 542 aa, Artificial Sequence
  VP1__Norovirus_and/or_Norovirus-like__LC145805
MKMASNDAAPSTDGAAGLVPESNSEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLAVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRVGFMTVSSNTSAPVVVPANGYFRFDSWVNQFYSLAPMGTGNGRRRIQ

SEQ ID NO: 2455 - protein, 542 aa, Artificial Sequence
  VP1__Norovirus_and/or_Norovirus-like__LC145797
MKMASNDAAPSTDGAAGLVPESNNEVMALEPVAGVALAAPVTGQTNIIDPWIRANFVPAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKLFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNISGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2456 - protein, 542 aa, Artificial Sequence
  VP1__Norovirus_and/or_Norovirus-like__LC145806
MKMASNDAAPSTDGAAGLVPESNSEVMALEPVAGAALAAPVTGQTNIIDPWIRAIFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLAVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRRIQ

SEQ ID NO: 2457 - protein, 542 aa, Artificial Sequence
  VP1__Norovirus_and/or_Norovirus-like__KU306738
MKMASNDAAPSNDGASSLVPEINNETMALEPVAGGAIAAPLTGQTNFIDPWIRNNYVQAPNGEFTISPRNSPGEILLNLELGPELNPFLAHLARMYNGYAGGVDVQVIMAGNAFTAGKVIFAAVPPHFPVESLSPPQITMFPHIIVDVRTLEPINIPIPDVRNNFFHYNQNNEPRMRLVAMLYTPLRSNGSADDVFTVSCRVLTKPSADFEFNYLVPPTVESRTKPFTIPILTIGEMTNSRFPVAIDMLYTSPTENLVVQPQNGRCTLEGELLGTTQLVTPNICSLRGAITGHEGNDDNHKWHMTVTNPNGSAFDPTEDVPAPLGTPDFIGDVYGVLSQRNRNIESGQTAPANRSHEAVISTRSNKFTPKLGSVMIATWNTNDVENQPTKFTPVGLENPGSFHQWELPNYSGALTLNMGLAPPVFPTYPGEQLLFFRSYIPLKGGFGNSIIDCLVPQEWIQHFYQESAPSQTDVALIRYVNPETGRVLFEAKLHRQGFITVAKTGDSPINVPANGYFRFDSWVNSFYSLAPMGTGNGRRRIQ

SEQ ID NO: 2458 - protein, 542 aa, Artificial Sequence
  VP1__Norovirus_and/or_Norovirus-like__KM036380
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGRFTPKIGTIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGNYPLVVPPNGHFRFDSWVNQFYSLAPMGTGNGRRRVQ

SEQ ID NO: 2459 - protein, 542 aa, Artificial Sequence
  VP1__Norovirus_and/or_Norovirus-like__AY113106
MKMASNDAAPSNDGAASLVPEGINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNETNVVQCQNGRCTLDGELQGTTQLLSSAVCSYRGRTVANNGDNWDQNLLQLTYPNGASYDPTDEVPAPLGTQDFSGMLYGVLTQDNVNVSTGEAKNAKGIYISTTSGKFTPKVGSIGLHSITEHVHPNQQSRFTPVGVAVNENTPFQQWVLPHYAGSLALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRIQ

SEQ ID NO: 2460 - protein, 542 aa, Artificial Sequence
  VP1__Norovirus_and/or_Norovirus-like__AB078334
MKMASNDAAPSNDGAASLVPEGINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFLVDMISPAQITMLPHLIVDVRTLEPIMTPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNETNVVQCQNGRCTLDGELQGTTQLLSSAVCFLQGRTVADNGDNWDQNLLQLTYPNGASYDPTDEVPAPLGTQDFSGMLYGVLTQDNVNVSTGEAKNAKGIYISTTSGKFTPKIGSIGLHSITEHVHPNQQSRFTPVGVAVDENTPFQQWVLPHYAGSLALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRIQ

SEQ ID NO: 2461 - protein, 542 aa, Artificial Sequence
  VP1__Norovirus_and/or_Norovirus-like__KM289172
MKMASNDAAPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKVIFAAIPPNFPTDNLSAAQITMCPHVIVDVRQLEPINLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTDNIVVQCQNGRVTLDGELMGTTQLLPSQICAFRGVLTRSTSRASDQADTATPRLFNYYWHIQLDNLNGTPYDPAEDIPAPLGTPDFRGKVFGVASQRNPDSTTRAHEAKVDTTSGRFTPKLGSLEISTESGDFDQNQPTRFTPVGIGVDSEADFQQWTLPDYSGQFTHNMNLAPAVAPNFPGEQLLFFRSQLPSSGGRSNGILDCLVPQEWVQHFYQESAPAQTQVALVRYVNPDTGRVLFEAKLHKLGYMTIAKSGDSPITVPPNGYFRFESWVNPFYTLAPMGTGN

SEQ ID NO: 2462 - protein, 542 aa, Artificial Sequence
  VP1__Norovirus_and/or_Norovirus-like__AY130762
MRMASSDAPVSGTDGAAGLVPESQQEVLPLEPVAGVQLAAPVAGQSNIIDPWIRMNFVQAPAGEFTVSPRNAPGEVLIDLELGPELNPYLNHLARMYNGYVGGMEVEVVLAGNAFTAGKILFAAVPPSFPTHGISAAQATMLPHVIVDVRQLEPVRLPLPDVRNVMFHFCQENKEPRMRIVAILYTPLRANGAGDDVFTVSCRVLTRPSPDFDFIFLVPPSVESKLKQFTLPNLQPNEMTNSRFPTGITQLYTSPNTNLVVQFQNGRCLLDGTLLGTTPVRAADICSFRGVTSTEVDATDSPRVAGSHRIMVQLKEPDGEEFSPTGPNPAPVGTPDFQAAIFGTLSQRNTGGAGQNSNRAHFAYFYTRNPTFAPGIGTVVFSFDTTDFQNRQPTKFSPSGVFDDNSSEPFNQFSLPYYNGSLGAVDAGKLAPPVAPNYPGEQILYFRGNIPFKGGYGEGEIDSLLPQEWITHFYAEQAPTQGDAALLRYYNPDTGRVLFECKLHREGFITINYTGSNALAVPVNGVFRFEGWVNKFYTLTPM

SEQ ID NO: 2463 - protein, 542 aa, Artificial Sequence
  VP1__Norovirus_and/or_Norovirus-like__KJ196290
MRMASSDAPVSGTDGAAGLVPESQQEVLPLEPVAGVQLAAPVAGQSNIIDPWIRMNFVQAPAGEFTVSPRNAPGEVLIDLELGPELNPYLNHLARMYNGYVGGMEVEVVLAGNAFTAGKILFAAVPPSFPTHGISAAQATMLPHVIVDVRQLEPVRLPLPDVRNVMFHFCQENKEPRMRIVAILYTPLRANGAGDDVFTVSCRVLTRPSPDFDFIFLVPPSVESKLKQFTLPNLQPNEMTNSRFPTGITQLYTSPNTNLVVQFQNGRCLLDGTLLGTTPVRAADICSFRGVTSTEVDATDSPRVAGSHRIMVQLREPDGEEFSPTGPNPAPVGTPDFQAAIFGTLSQRNTGGAGQNSNRAHFAYFYTRNPTFAPGIGTVVFSFDTTDFQNRQPTKFSPSGVFDDDSSEPFNQFSLPYYNGSLGAVDAGKLAPPVAPNYPGEQILYFRGSVPFKGGYGEGEIDSLLPQEWITHFYAEQAPTQGDAALLRYYNPDTGRVLFECKLHREGFITINYTGSNALAVPVNGVFRFEGWVNKFYTLTPM

SEQ ID NO: 2464 - protein, 542 aa, Artificial Sequence
  VP1__Norovirus_and/or_Norovirus-like__GQ856474
MRMASSDAPVSGTDGAAGLVPESQQEVLPLEPVAGVQLAAPVAGQSNIIDPWIRMNFVQAPAGEFTVSPRDAPGEVLIDLELGPELNPYLNHLARMYNGYVGGMEVEVVLAGNAFTAGKILFAAVPPSFPTHGISAAQATMLPHVIVDVRQLEPVRLPLPDVRNVMFHFCQENKEPRMRIVAILYTPLRANGAGDDVFTVSCRVLTRPSPDFDFIFLVLPSVESKLKQFTLPNLQPNEMTNSRFPTGIIQLYTSPNTNLVVQFQNGRCLLDGTLLGTTPVRAADICSFRGVTSTEVDATDSPRVAGSHRIMVQLKEPDGEEFSPTGPNPAPVGTPDFQAAIFGTLSQRNTGGAGQNSNRARFAYFYTRNPTFAPGIGTVVFSFDTTDFQNRQPTKFSPSGVFDDDSSEPFNQFSLPYYNGSLGAVDAGKLAPPVAPNYPGEQILYFRGNIPFKGGYGEGEIDSLLPQEWITHFYAEQAPTQGDAALLRYYNPDTGRVLFECKLHREGFITINYTGSNALAVPVNGVFRFEGWVNKFYTLTPM

SEQ ID NO: 2465 - protein, 542 aa, Artificial Sequence
  VP1__Norovirus_and/or_Norovirus-like__LC145787
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2466 - protein, 542 aa, Artificial Sequence
  VP1__Norovirus_and/or_Norovirus-like__AB629946
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFTVSIDQMYTSLNEVISVQCQNGRCTLDGELRGTTQLQVSGICAFKGEVTAHVHDNDHLYNVTITNLNGSPFDPSEDVPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2467 - protein, 542 aa, Artificial Sequence
  VP1__Norovirus_and/or_Norovirus-like__KT962983
MKMASNDAAPSTDGAAGLVPESNTEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRRVQ

SEQ ID NO: 2468 - protein, 541 aa, Artificial Sequence
  VP1__Norovirus_and/or_Norovirus-like__AB083780
MKMASNDAAPSNDGAAGLVPEINTEVMALEPVAGGAIAAPLTGQTNIIDPWIRNNFVQAPNGEFTISPRNSPGEILLNMELGPELNPFLAHLSRMYNGFAGGMEVQVLMAGNAFTAGKVIFAAVPPHFPVENLSPPQITMFPHIIIDVRTLEPVLLPMPDVRNQFFHYNQVNEPRMRLVAMLYTPLRSNGSTEDVFTVSCRVLTRPSPDFEFNYLVPPTVESRTKPFTLPVLTIGEMTNSRFPAPIDMLYTSPNGNVVVQPQNGRCTLDGELQGSTQLVPANVCAFRGKITARIVDQAAHQWHMQIDNPNGTLFDPTEDVPAPLGTPDFKAKIFGVISQRNDYNDGSQGPANRAHDAVVPTTSAKFTPKLGSILVGTWENNDIETQPSKFTPVGLLEMNDFNQWSLPNYSGALTLNMGLAPAVFPTFPGEQILFFRSFIPLKGGHGNPAIDCLLPQEWIQHFYQESAPSQTSVALIRYVNPDTGRVLFEGKLHRQGFITIAKSGDGPIVVPPNGYFRFDSWVNQFYSLAPMGNGNGRRRIQ

SEQ ID NO: 2469 - protein, 541 aa, Artificial Sequence
  VP1__Norovirus_and/or_Norovirus-like__KX987840
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMADLPVIQPRLCTHARWPAPVYGLLVDPSLPSNPQWQNGRVHVDGTLLGTTPISGSWVSCFAAEAAYEYQSGTGEVATFTLIEQDGSAYVPGDRAAPLGYPDFSGQLEIEVQTETTKPGDKLKVTTFEMILGPTTNVDQAPYQGRVYASVTAAATLNLVDGRVRAVPRSIYGFQDVIPEYNDGLLVPLAPPIGPFLPGEVLLRFRTYMRQIDSSDAAAEAIDCALPQEFISWFASNAFTVQSEALLLRYRNTLTGQLLFECKLYSEGYIALSYPGSGPLTFPTDGFFEVVSWVPRLYQLASVGSLATGRTLKQ

SEQ ID NO: 2470 - protein, 541 aa, Artificial Sequence
  VP1__Norovirus_and/or_Norovirus-like__KR349276
MRMSDGAAPKANGSEANGQDLVPTAVEQAVPIQPVAGASLAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLGSNPQWQNGRVHVDGTLLGTTPISGSWVSLFAAEAAYEFQSGTGEVATFTLIEQDGSAYVPGERAAPLGYPDFSGQLEIEVQTETTKTGDKLKVTTFEMILGPTTNVDQAPYQGRVYASLTTAASLDLVDGRVRAVPRSIYGFQDVIPEYNDGLLVPLAPPIGPFLPGEVLLRFRTYMRQIDSSDAAAEAIDCALPQEFVSWFASNAFTVQSEALLLRYRNTLTGQLLFECKLYSEGYIALSYSGSGPLTFPTDGFFEVVSWGPRLYQLASVGSLATGRTLKQ

SEQ ID NO: 2471 - protein, 541 aa, Artificial Sequence
  VP1__Norovirus_and/or_Norovirus-like__KM102449
MRMSDGAAPKANGSEAIGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRALEPIQLPLLDVRRVLWHATQDQEESMRLVCMLYTPLRTNSPGDESFVVSGRLLSKPAADFNFVYLTPPIERTVYRMVDLPVLQPRLCTHARWPAPVYGLLVDPSLPSNPQWQNGRVHVNGTLLGTTPVSGSWVSCFAAEAAYEFQSGTGEVATFTMIEQDGSAYVPGDRAAPLGYPDFSGQLEIEVQTETTKSGDKLKVTTFEMILGPTTNADQAPYQGKVYASLAAAAPLDLVDGRVRAVPRSVYFFQDVLPEYNDGLLVPLAPPLGPFLPGEVLLRFRTYVRQLDTADAAAQPIDCALPQEFISWFASNSFTVQSEALLIRYRNTLTGQLLFEAKLYSEGYIAVSYSGSGPLTFPTDGFFEVVSWVPRLFQLASVGSLATGRTLKQ

SEQ ID NO: 2472 - protein, 541 aa, Artificial Sequence
  VP1__Norovirus_and/or_Norovirus-like__KC792553
MRMSDGAAPKANGSEASGQDLVPTAVEQAVPIQPVAGAALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPVYGLLVDPSLPSNPQWQNGRVHVDGTLLGTTPVSGSWVSCFAAEAAYEFQSGIGQVATFTMIEQDGSAYVPGDRAAPLGYPDYSGQLEIEVQTETTKAGDKLKVTTFEMILGPTTNADQAPYQGRAYASLTAAASLDLVDGRVRAVPRSIYSFQDVLPEYNDGLLVPLAPPLGPFLPGEVLLRFRTYMRQLDTADAAAQPIDCALPQEFVSWFASNSFTVQSDALLVRYRNTLTGQLLFEAKLYSEGYIAVSYSGSGPLTFPADGIFEVVSWVPRLFQLASVGSLATGRTLKQ

SEQ ID NO: 2473 - protein, 541 aa, Artificial Sequence
  VP1__Norovirus_and/or_Norovirus-like__AB809991
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRV

SEQ ID NO: 2474 - protein, 541 aa, Artificial Sequence
  VP1__Norovirus_and/or_Norovirus-like__AB809990
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRV

SEQ ID NO: 2475 - protein, 541 aa, Artificial Sequence
  VP1__Norovirus_and/or_Norovirus-like__AB809977
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSERTGEAKNAKGIYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRV

SEQ ID NO: 2476 - protein, 541 aa, Artificial Sequence
  VP1__Norovirus_and/or_Norovirus-like__AB809987
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLIQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRRV

SEQ ID NO: 2477 - protein, 541 aa, Artificial Sequence
  VP1__Norovirus_and/or_Norovirus-like__AJ844469
MMMASKDAPSNMDGTSGAGQLVPEANTADPIPLEPVVGAATAAATAGQVNMIDPWIMNNFVQSPEGEFTISPNNTPGDILFDLQLGPHLNPFLQHLSQMYNGWVGNMRVRILLAGNAFSAGKIIICCVPPGFTAQNISIAQATMFPHVIADVRVLEPIEIPLDDVRNVLFHTNENKPTMRLLCMLYTPLRAGGASAGTDPFVIAGRVLTCPSPDFNFLFLVPPSVEQKTRQLTVPNIPLNNLSNSRVPAMISKMAISSDANQVVQFQNGRCTTDGQLLGTTPISASQVARIRGKVFSTSSGKGLNLSELDGSPYHAFESPAPVGFPDLGYCDWHVSSFKADHNSSSDPISRLDIKQGASFAPHLGSIEYTTSQNPDGDQLGTLTWISSPSDDTPGHGTINLWKIPSYGSTVTESVHLAPPIYPPGFGETLVYFMSDFPIGHTNSNMAQVPCTLPQEFVAHFVNEQAPVRGDAALLHYVDPDTHRNLGEFKLYPEGYITCVPNTGGGGPQSLPINGVFIFSSWVSRYYQLKPVGTAGPARRL

SEQ ID NO: 2478 - protein, 541 aa, Artificial Sequence
  VP1__Norovirus_and/or_Norovirus-like__AY675555
MKMASKDAPSNMDGTSGAGQLVPEANTADPIPLEPVVGAATAAATAGQVNMIDPWIMNNFVQSPEGEFTISPNNTPGDILFDLQLGPHLNPFLQHLSQMYNGWVGNMRVRILLAGNAFSAGKIIICCVPPGFTAQNISIAQATMFPHVIADVRVLEPIEIPLDDVRNVLFHTNENRPTMRLLCMLYTPLRAGGASAGTDPFVIAGRVLTCPSPDFNFLFLVPPSVEQKTRQLTVPNIPLNNLSNSSVPAMINKMAISSDANQVVQFQNGRCTTDGQLLGTTPISASQVARIRGKVFSTSSGKGLNLSELDGSPYHAFESPAPVGFPDLGHCDWHVSSFKADQNSSGDPISRLDIKQGASFAPHLGSIEYTTSQNPDGGQLGTLTWISSPSDDTPGHGTINLWKIPSYGSTVTESVHLAPPIYPPGFGETLVNLMSNFPIGHTNSNMAQVPCTLPQEFVAHFVNEQAPVRGDAALLHYVDPDTHRNLGEFKLYPEGYITCVPNTGGGGPQSLPTNGVFIFSSWVSRYYQLEPVGTAGPARRL

SEQ ID NO: 2479 - protein, 541 aa, Artificial Sequence
  VP1__Norovirus_and/or_Norovirus-like__EU085479
MKMASSDATPSNDGAAGLVPEINNEAMALDPVAGAAIAAPLTGQQNIIDPWIMNNFVQAPGGEFTVSPRNSPGEVLLNLELGPEINPYLAHLARMYNGYAGGFEVQVVLAGNAFTAGKIIFAAIPPNFPIDNLSAAQITMCPHVIVDVRQLEPVNLPMPDVRNNFFHYNQGSDSRLRLIAMLYTPLRANNSGDDVFTVSCRVLTRPSPDFSFNFLVPPTVESKTKPFTLPILTISEMSNSRFPVPIDSLHTSPTENIVVQCQNGRVTLDGELMGTTQLLPSQICAFRGVLTRSTSRTSDQADTATPRLFNYYWHIQLDNLNGTPYDPAEDIPGPLGTPDFRGKVFGVASQRNPDSTTRAHEAKVDTTAGRFTPKLGSLEISTESSDFDQNQPTRFTPVGIGVDHETDFQQWSLPDYSGQFTHNMNLAPAVAPNFPGEQLLFFRSQLPSSGGRSNGILDCLVPQEWVQHFYQESAPAQTQVALVRYVNPDTGRVLFEAKLHKLGFMTIAKNGDSPITVPPNGYFRFESWVNPFYTLAPMGSG

SEQ ID NO: 2480 - protein, 541 aa, Artificial Sequence
  VP1__Norovirus_and/or_Norovirus-like__AF542090
MASKDAPVSGTDGAAGLVPESQQEVLPLEPVAGVQLAAPVAGQSNIIDPWIRMNFVQAPAGEFTVSPRNAPGEVLIDLELGPELNPYLNHLARMYNGYVGGMEVEVVLAGNAFTAGKVLFAAVPPSFPTHGITAAQATMLPHVIVDVRQLEPVRLPLPDVRNVMFHFCQENKEPRMRIVAILYTPLRANGAGDDVFTVSCRVLTRPSPDFDFIFLVPPSVESKLKQFTLPNLQPNEMTNSRFPTSVTQLYTSPNTNLVVQFQNGRCQLDGTLLGTTPVRAADICSFRGITSAEVDTTDSSRVAGSHRVMVQLKEPDGEEFSPTGPNPAPVGTPDFQAAIFGTLSQRNNTGGSGQNSNRSHFAYFYTRNPTFAPGIGTVVFSFDTTDFQNRQPTKFSPSGVYDDDSSEPFNQFSLPYYNGSLGAVDAGKLAPPVAPNYPGEQILYFRGNIPFKGGYGGGEIDCLLPQEWITHLYAEQAPTQGDAALLRYYNPDTGRVLFECKLHREGFITINYTGSNALAVPVNGVFRFEGWVNKFYTLTPM

SEQ ID NO: 2481 - protein, 540 aa, Artificial Sequence
  VP1__Norovirus_and/or_Norovirus-like__KM386680
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPPQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 2482 - protein, 540 aa, Artificial Sequence
  VP1__Norovirus_and/or_Norovirus-like__AF397156
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQLQACNICSIRGKVTGQVPNEQHMWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDPWGNQFYSLAPMGTGNGRRRFQ

SEQ ID NO: 2483 - protein, 540 aa, Artificial Sequence
  VP1__Norovirus_and/or_Norovirus-like__AF414422
MKMASNDATPSNDGAAGLVPESNNEAMALEPVVGASLAAPVTGQTNIIDPWIRTNFVQAPNGEFTVSPRNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGELLGTTQPQACNICSIRGKVTGQVPNEQHTWNLEITNLNGTQFDPTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFGFDSWVNQFYSLAPMGTGNGRRRFQ

SEQ ID NO: 2484 - protein, 540 aa, Artificial Sequence
  VP1__Norovirus_and/or_Norovirus-like__AF414423
MKMASNDATPSNDGAAGLVPESNNEAMALEPVVGASLAAPVTGQTNIIDPWIRTNFVQAPNGEFTVSPRNSPGEILVNLESGPELNPYLAHLARMYNGYAGGMEVQVMLAGNAFTAGKIIFAAVPPYFPVENLSPSQITMFPHVIIDVRTLEPVLLPMPDVRSTPFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLDGGLLGTTQLQACNICSIRGKVTGQVPSEQHMWNLEITNLNGTQFDPTDDVPAPLGVPDFAGEVFGVLSQRNRGESNSANRAHDAVVATYSDKYTPKLGLVQIGTWNTNDVENQPTKFTPIGLNGVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 2485 - protein, 540 aa, Artificial Sequence
  VP1__Norovirus_and/or_Norovirus-like__GQ856476
MKMASNDAAPSNDGAAGLVPEVNNETMALEPVAGASIAAPLTGQNNVIDPWIRLNFVQAPNGEFTVSPRNSPGEILLNLELGPELNPYLAHLSRMYNGYAGGVEVQVLLAGNAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLADDRHLWNIQVSNLNGTPFDPTDDVPAPLGMPDFSGQIFGVVSQRDTGTNPANRAHDAVLATYSAKYTPKLGSVQIGTWDTEDLLERQPVKFTPVGLNEIGQDKHFDQWVLPNYSGALGLNMHLAPAVSPLFPGERLLFFRSYIPLKGGHGDPFIDCLVPQEWIQHFYQESAPAQSSVALLRYVNPDTGRTLFEAKLHKGGFITVSSTENRPVIVPPNGYFRFDSWVNQFYSLAPMGTGNGRRRMQ

SEQ ID NO: 2486 - protein, 540 aa, Artificial Sequence
  VP1__Norovirus_and/or_Norovirus-like__AJ277607
MKMASNDATPSNDGAAGLVPESNNEAMALEPVVGASLAAPVTGQTNIIDPWIRTNFVQAPNGEFTVSPKNSPGEILVNLELGPELNPYLAHLARMYNGYAGGMEVQVMLAGNAFTAGKIIFAAVPPYFPVENLSPSQITMFPHVIIDVRTLEPVLLPMPDVRSTLFHFNQKDEPKMRLVAMLYTPLRSNGSGDDVFTVSCRILTRPSPEFDFTYLVPPTVESKTKPFTLPVLTLGELSNSRFPLSIDEMVTSPNESIVVQPQNGRVTLYGELLGTAQLQACNICSIRGKVTGQFPNEQNMWNLEITNLNGTQFDLTDDVPAPLGVPDFAGEVFGVLSQRNRGESNPANRAHDAVVATYSDKYTPKLGLVQIGTWNTNDVENQPTKFTPIGLNEVANGHRFEQWTLPRYSGALTLNMNLAPAVAPLFPGERLLFFRSYVPLKGGFGNPAIDCLVPQEWVQHFYQESAPSLGDVALVRYVNPDTGRVLFEAKLHKGGFLTVSSTSTGPVVVPANGYFRFDSWVNQFYSLAPMGTGNGRRRFQ

SEQ ID NO: 2487 - protein, 540 aa, Artificial Sequence
  VP1__Norovirus_and/or_Norovirus-like__AY772730
MKMASNDAAPSNDGAAGLVPEVNNETMALEPVAGASIAAPLTGQNNVIDPWIRLNFVQAPNGEFTVSPRNSPGEILLNLELGPELNPYLAHLARMYNGYAGGVEVQVLLAGSAFTAGKLVFAAIPPHFPVDNLSPGQITMFPHVIIDVRTLEPVLLPLPDVRNNFFHYNQQSDQRMRLVAMLYTPLRSNGSGDDVFTVSCRVLTRPSPDFDFNYLVPPTVESKTKPFSVPVLTLNELTNSRFPVPIDAMYTSPNDSIVVQPQNGRATIDGELLGTTQLIPSGICSFRGKITTHLSDDRHLWNIQVSNLNGTPFDPTDDVPAPLGMPDFSGQIFGVVSQRDTGTNPANRAHDAALATYSAKYTPKLGSVQIGAWDTEDLLERQPVKFSPVGLSEIGQDKHFDQWVLPNYSGALGLNVHLAPAVSPLFPGERLLFFRSYIPLKGGHGDPFIDCLVPQEWIQHFYQESAPAQSSVALLRYVNPDTGRTLFEAKLHKEGFITVSSTENRPVIVPPNGYFRFDSWVNQFYSLAPMGTGNGRRRMQ

SEQ ID NO: 2488 - protein, 540 aa, Artificial Sequence
  VP1__Norovirus_and/or_Norovirus-like__KT315718
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPDSTRAQQASVSTYSPQFVPKLGSVNLRISNNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2489 - protein, 540 aa, Artificial Sequence
  VP1__Norovirus_and/or_Norovirus-like__KT315708
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2490 - protein, 540 aa, Artificial Sequence
  VP1__Norovirus_and/or_Norovirus-like__KT315697
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRALFEAKLHRSGYITVAHSGDYPLVVPANGHFRFDSWVNQFYSLAPMGTGNGRRRAQ

SEQ ID NO: 2491 - protein, 540 aa, Artificial Sequence
  VP1__Norovirus_and/or_Norovirus-like__KT315689
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVSHSGDYPLVVPANGHFRFDSWVNQFYSLAPMGTGNGRRRAQ

SEQ ID NO: 2492 - protein, 540 aa, Artificial Sequence
  VP1__Norovirus_and/or_Norovirus-like__KX216805
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2493 - protein, 540 aa, Artificial Sequence
  VP1__Norovirus_and/or_Norovirus-like__KU557859
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGVIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2494 - protein, 540 aa, Artificial Sequence
  VP1__Norovirus_and/or_Norovirus-like__KU557828
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPDSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2495 - protein, 540 aa, Artificial Sequence
  VP1__Norovirus_and/or_Norovirus-like__KT315692
MKMASNDAAPSNDGAAGLVPEGNNETLPLEPVAGAAIAAPVTGQNNIIDPWIRTNFVQAPNGEFTVSPRNSPGEILLSLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2496 - protein, 540 aa, Artificial Sequence
  VP1__Norovirus_and/or_Norovirus-like__KX168437
MKMASNDAAPSNDGAAGLVPEGNNETLPLEPVAGAAIAAPVTGQNNIIDPWIRTNFVQAPNGEFTVSPRNSPGEVLLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2497 - protein, 540 aa, Artificial Sequence
  VP1__Norovirus_and/or_Norovirus-like__KX168440
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWVQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2498 - protein, 540 aa, Artificial Sequence
  VP1__Norovirus_and/or_Norovirus-like__KX216793
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLVPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2499 - protein, 540 aa, Artificial Sequence
  VP1__Norovirus_and/or_Norovirus-like__KU557881
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSLVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2500 - protein, 540 aa, Artificial Sequence
  VP1__Norovirus_and/or_Norovirus-like__KY424350
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNNRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSINLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2501 - protein, 540 aa, Artificial Sequence
  VP1__Norovirus_and/or_Norovirus-like__KU557884
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGATYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2502 - protein, 540 aa, Artificial Sequence
  VP1__Norovirus_and/or_Norovirus-like__KU561253
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHTFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2503 - protein, 540 aa, Artificial Sequence
  VP1__Norovirus_and/or_Norovirus-like__KP902588
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSSVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2504 - protein, 540 aa, Artificial Sequence
  VP1__Norovirus_and/or_Norovirus-like__KX168456
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDGGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2505 - protein, 540 aa, Artificial Sequence
  VP1__Norovirus_and/or_Norovirus-like__KX168444
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESSPSQSDVALIRYVNPDTGRTLFEAKLHRSGYITVAHSGDYPLVVPANGHFRFDSWVNQFYSLAPMGTGNGRRRAQ

SEQ ID NO: 2506 - protein, 540 aa, Artificial Sequence
  VP1__Norovirus_and/or_Norovirus-like__KX216806
MKMATNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2507 - protein, 540 aa, Artificial Sequence
  VP1__Norovirus_and/or_Norovirus-like__KX216794
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLCELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2508 - protein, 540 aa, Artificial Sequence
  VP1__Norovirus_and/or_Norovirus-like__KX420895
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNALQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPSFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2509 - protein, 540 aa, Artificial Sequence
  VP1__Norovirus_and/or_Norovirus-like__KT591501
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEIQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2510 - protein, 540 aa, Artificial Sequence
  VP1__Norovirus_and/or_Norovirus-like__KT315714
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWISTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2511 - protein, 540 aa, Artificial Sequence
  VP1__Norovirus_and/or_Norovirus-like__KT315673
MKMASNDAAPSNDGAAGLVPEGNNETLPLEPVAGAAIAAPVTGQNNIIDPWIRTNFVQAPNGEFTVSPKNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2512 - protein, 540 aa, Artificial Sequence
  VP1__Norovirus_and/or_Norovirus-like__KX216792
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQHNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNFRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2513 - protein, 540 aa, Artificial Sequence
  VP1__Norovirus_and/or_Norovirus-like__KU953398
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGTDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2514 - protein, 540 aa, Artificial Sequence
  VP1__Norovirus_and/or_Norovirus-like__KU557888
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGSTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2515 - protein, 540 aa, Artificial Sequence
  VP1__Norovirus_and/or_Norovirus-like__KU557808
MKMASNDVAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWVQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2516 - protein, 540 aa, Artificial Sequence
  VP1__Norovirus_and/or_Norovirus-like__KU557807
MKMASNDVAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2517 - protein, 540 aa, Artificial Sequence
  VP1__Norovirus_and/or_Norovirus-like__KX371111
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2518 - protein, 540 aa, Artificial Sequence
  VP1__Norovirus_and/or_Norovirus-like__KX371110
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQHDRWHMQLQNLNGTTYDPTDDVPAPLGTPDFKGVVFGMVSQRNVGTDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2519 - protein, 540 aa, Artificial Sequence
  VP1__Norovirus_and/or_Norovirus-like__KX134669
MKMASSDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2520 - protein, 540 aa, Artificial Sequence
  VP1__Norovirus_and/or_Norovirus-like__KU557871
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNALQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2521 - protein, 540 aa, Artificial Sequence
  VP1__Norovirus_and/or_Norovirus-like__KX371108
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEIQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2522 - protein, 540 aa, Artificial Sequence
  VP1__Norovirus_and/or_Norovirus-like__KU557829
MKMASNDAAPSNDGAAGLVPEGNNETLPLEPVAGAAIAAPVTGQNNITDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPDSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2523 - protein, 540 aa, Artificial Sequence
  VP1__Norovirus_and/or_Norovirus-like__KX168452
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPAPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2524 - protein, 540 aa, Artificial Sequence
  VP1__Norovirus_and/or_Norovirus-like__KU953393
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSSICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2525 - protein, 540 aa, Artificial Sequence
  VP1__Norovirus_and/or_Norovirus-like__KR052020
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQPDVALIRYVNPDTGRTLFEAKLHRSGYITVAHSGDYPLVVPANGHFRFDSWVNQFYSLAPMGTGNGRRRAQ

SEQ ID NO: 2526 - protein, 540 aa, Artificial Sequence
  VP1__Norovirus_and/or_Norovirus-like__KT315687
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQSNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2527 - protein, 540 aa, Artificial Sequence
  VP1__Norovirus_and/or_Norovirus-like__KX356908
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLSSDICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDHPLVVPANGHFRFDSWVNQFYSLAPMGTGNGRRRAQ

SEQ ID NO: 2528 - protein, 540 aa, Artificial Sequence
  VP1__Norovirus_and/or_Norovirus-like__KX024652
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFHPTKFTPVGVNDDNDGPPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2529 - protein, 540 aa, Artificial Sequence
  VP1__Norovirus_and/or_Norovirus-like__KT315706
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTSDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2530 - protein, 540 aa, Artificial Sequence
  VP1__Norovirus_and/or_Norovirus-like__KX134670
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTMPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2531 - protein, 540 aa, Artificial Sequence
  VP1__Norovirus_and/or_Norovirus-like__KT780399
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCTVLTRPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2532 - protein, 540 aa, Artificial Sequence
  VP1__Norovirus_and/or_Norovirus-like__KP902577
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCTVLTTPTPDFEFTYLVPPSVESKTKPFSLPILTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2533 - protein, 540 aa, Artificial Sequence
  VP1__Norovirus_and/or_Norovirus-like__KU587628
MKMASNDAAPSNDGAAGLVPEGNNETLPLEPVAGAAIAAPVTGQNNIIDPWIRTNFVQAPYGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKNKPFSLPIFTLSELTNSRFPVPIDSLFTAQNNVLQVQCQNGRCTLDGELQGTTQLLPTGICAFRGRVTAQINQRDRWHMQLQNLNGTTYDPTDDVPAPLGTPDFKGVVFGMVSQRNVGNDAPGSTRAQQAWVSTYSPQFVPKLGSVNLRISDNDDFQFQPTKFTPVGVNDDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2534 - protein, 540 aa, Artificial Sequence
  VP1__Norovirus_and/or_Norovirus-like__AF414409
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVEMMYTSRNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRSHEANINTGGDQYAPKLAQVKIFSQSQDFEVHQPTVFTPVGVAGDTSHPFRQWTLPRYGGHLTNNTHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRIQ

SEQ ID NO: 2535 - protein, 540 aa, Artificial Sequence
  VP1__Norovirus_and/or_Norovirus-like__KT943504
MKMASNDAAPSNDGAAGLVPEINNEVMPLEPVAGASLATPVVGQQNIIDPWIRTNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEITAKSVDVRSYRMDMEITNTDGTPIDPTEDTPGPIGSPDFRGILFGVASQRNKGEQIPATRAHEANINTGGDQYAPKLAQVKFFSGSQDFEVHQPTVFTPVGVAGDSSHPFQQWALPRYGGHLTNNTHLAPAVAPLFPGEQILFFRSQIPSSGGHEMGYMDCLVPQEWVQHFYQEAATAQSEVALIRFVNPDTGRVLFEAKLHKQGFITVAHTGDNPIVMPPNGHFRFEAWVNQFYSLAPVGTGNGRRRIQ

SEQ ID NO: 2536 - protein, 540 aa, Artificial Sequence
  VP1__Norovirus_and/or_Norovirus-like__KT943505
MKMASNDAAPSNDGAAGLVPEINNEVMPLEPVAGASLATPVVGQQNIIDPWIRTNFVQAPAGEFTVSPRNSPGEILLDLELGPELNPYLAHLARMYNGHAGGMEVQIVLAGNAFTAGKIIFAAIPPGFPYENLSPSQITMCPHVIIDVRQLEPVLLPMPDIRNNFFHYNQGNDPKLRLVAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEITAKSVDVRSYRMDMEITNTDGTPIDPTEDTPGPIGSPDFRGILFGVASQRNKGEQIPATRAHEANINTGGDQYAPKLAQVKFFSGSQDFEVHQPTVFTPVGVAGDSSHPFQQWALPRYGGHLTNNTHLAPAVAPLFPGEQILFFRSQIPSSGGHELGYMDCLVPQEWVQHFYQEAATAQSEVALIRFVNPDTGRVLFEAKLHKQGFITVAHTGDNPIVMPPNGHFRFEAWVNQFYSLAPVGTGNGRRRIQ

SEQ ID NO: 2537 - protein, 540 aa, Artificial Sequence
  VP1__Norovirus_and/or_Norovirus-like__KT962982
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYKGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFITIAATGSNPVVVPPNGYFRFDSWVNQFYALAPMGTGNGRRRAQ

SEQ ID NO: 2538 - protein, 540 aa, Artificial Sequence
  VP1__Norovirus_and/or_Norovirus-like__KX079488
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTIFEAKLHRQGFITIAATGSNPVVVPPNGYFRFDSWVNQFYALAPMGTGNGRRRAQ

SEQ ID NO: 2539 - protein, 540 aa, Artificial Sequence
  VP1__Norovirus_and/or_Norovirus-like__KR921938
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWISHFYQESAPSQSDVALVRYVNPDTGRTIFEAKLHRQGFITIAATGSNPVVVPPNGYFRFDSWVNQFYALAPMGTGNGRRRAQ

SEQ ID NO: 2540 - protein, 540 aa, Artificial Sequence
  VP1__Norovirus_and/or_Norovirus-like__KR921940
MKMASNDAAPSNDGAAGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADVVVQPQNGRCTLDGELQGTTQLLTTAICSYRGTTSNPTSDYWDDHLLHLVHPNGATYDPTEDVPAPFGTQDFRGILYGVLTQNTQNPRDEVSNSRGIYISSTSDKFTPKLGTIGLHQVQGDTASNQQSKFTPVGIAVNQNTPFKQWELPNYSGALTLNTNLAPAVGPNFPGEQILFFRSNVPSVQGNHPTQEIDCLIPQEWVSHFYQESAPSQSDVALVRYVNPDTGRTTFEAKLHRQGFITIAATGSNPVVVPPNGYFRFDSWVNQFYALAPMGTGNGRRRAQ

SEQ ID NO: 2541 - protein, 540 aa, Artificial Sequence
  VP1__Norovirus_and/or_Norovirus-like__DQ358209
MKMASNDAAPSNDGAAGLVPEINNEVMPLEPVAGASLATPVVGQQNIIDPWIRNNFVQAPAGEFTVSPRNSPGEILLDLELGPELNPYLAHLARMYNGHAGGMEVQIVLAGNAFTAGKIVFAAIPPGFPYENLSPSQITMCPHVIIDVRQLEPVLLLMPDIKNNFFHYNQGNDPKLRLVAMLYTPLRANNSGDDVFTVSCRVLTKPSPDFEFTFLVPPTVESKTKQFTLPILKISEMTNSRFPVPVEMMYTARNENQVVQPQNGRVTLDGELLGTTPLLAVNICKFKGEVIAKNGDVRSYRMDMEITNTDGTPIDPTEDTPGPIGSPDFQGILFGVASQRNKNEQNPATRAQEVNINTGGDQYAPKLAQVKFFSESQDFEVHQPTVFTPVGVAGDPSHPFRQWTLPRYGGHLTNNIHLAPAVAPLFPGEQILFFRSQIPSSGGHELGYMDCLVPQEWVQHFYQEAATAQSEVALIRFINPDTGRVLFEAKLHKQGFITVAHTGDNPIVMPPNGYFRFEAWVNQFYSLAPVGTGNGRRRVQ

SEQ ID NO: 2542 - protein, 540 aa, Artificial Sequence
  VP1__Norovirus_and/or_Norovirus-like__KP784694
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAADPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLATQNWNSYDPTEEIPAPLGTPDFVGKIQGVLTQTTKTDGSTRSHKATVYTGSADFAPKLGRVQFETDTNNDFETNQNTKFTPVGVIQNGETAHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGSHDLVIPPNGYFRFDSWVNQFYTLAPMGNGTGRRRAT

SEQ ID NO: 2543 - protein, 540 aa, Artificial Sequence
  VP1__Norovirus_and/or_Norovirus-like__KX354064
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRAM

SEQ ID NO: 2544 - protein, 540 aa, Artificial Sequence
  VP1__Norovirus_and/or_Norovirus-like__LC177658
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRVA

SEQ ID NO: 2545 - protein, 540 aa, Artificial Sequence
  VP1__Norovirus_and/or_Norovirus-like__KX514232
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSPIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKRAS

SEQ ID NO: 2546 - protein, 540 aa, Artificial Sequence
  VP1__Norovirus_and/or_Norovirus-like__LC145787
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDVPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2547 - protein, 540 aa, Artificial Sequence
  VP1__Norovirus_and/or_Norovirus-like__KT962983
MKMASNDAAPSTDGAAGLVPESNTEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNITITNLNGSPFDPSEDIPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYIPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2548 - protein, 540 aa, Artificial Sequence
  VP1__Norovirus_and/or_Norovirus-like__AB629946
MKMASNDAAPSTDGAAGLVPESNNEVMALEPVAGAALAAPVTGQTNIIDPWIRANFVQAPNGEFTVSPRNAPGEVLLSLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFTVSIDQMYTSLNEVISVQCQNGRCTLDGELRGTTQLQVSGICAFKGEVTAHVHDNDHLYNVTITNLNGSPFDPSEDVPAPLGVPDFQGRVFGIISQRDKHNSPGHNEPANRGHDAVVPTYTAQYTPKLGQIQIGTWQTDDLTVNQPVKFTPVGLNDTEHFNQWVVPRYAGALNLNTNLAPSVAPVFPGERLLFFRSYVPLKGGYGNPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2549 - protein, 540 aa, Artificial Sequence
  VP1__Norovirus_and/or_Norovirus-like__AB809993
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRRR

SEQ ID NO: 2550 - protein, 540 aa, Artificial Sequence
  VP1__Norovirus_and/or_Norovirus-like__JQ743330
MMMASKDAPPNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIRSMMVSRDHGQMVQFQNGRVTLDGQLQGTTPTSASQLCKIRGSVFHANGGNGYNLTELDGSPYHAFESPAPIGFPDLGECDWHMEASPTTQFDTGDVIKQINVKQEAAFAPHLGTIQADGLSDVSVNTNMIAKLGWVSPVSDGHRGSVDPWVIPRYGSTLTEAAQLAPPIYPPGFGEAIVFFMSDFPIAHGANGLSVPCTIPQEFVTHFVNEQAPTRGEAALLHYLDPDTHRNLGEFKLYPEGFMTCVPNSSGTGPQTLPINGVFAFVSWVSRFYQLKPVGTAGPARRL

SEQ ID NO: 2551 - protein, 540 aa, Artificial Sequence
  VP1__Norovirus_and/or_Norovirus-like__AF439267
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPVGFPDLGECDWHMEASPTTQFNTGDVIKQINVKQESAFAPHLGTIQADGLSDVSVNTNMIAKLGWVSPVSDGHKGDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRL

SEQ ID NO: 2552 - protein, 540 aa, Artificial Sequence
  VP1__Norovirus_and/or_Norovirus-like__EF547393
MMMASKGAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFVAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLEWVSPVSDGHKGDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRL

SEQ ID NO: 2553 - protein, 540 aa, Artificial Sequence
  VP1__Norovirus_and/or_Norovirus-like__AF145709
MMMASKDAPPNMDGTSGAGQLIPEANTAEPISMEPVAGAATAAATAGQVNMIDPWIMNNYVQAPQGEFTISPNNTPGDILFDLQLGPHLNPFLSHLAQMYNGWVGNMKMKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTALDGSPYHAFESPAPIGFPDLGECDWHMEASPTTQFDTGDVIKQINVKQESAFAPHLGTIQADGLSDVSVNTNMIAKLGWVSPVSDGHRGNVDPWVIPRYGSTLTEAAQLAPPIYPPGFGEAIVFFMSDFSIAHGTNGLSVPCTIPQEFVTHFVNEQAPTRGEAALLHYLDPDTHRNLGEFKLYPEGFMTCVPNSSGTGPQTLPINGVFVFVSWVSRFYQLKPVGTAGPARRL

SEQ ID NO: 2554 - protein, 540 aa, Artificial Sequence
  VP1__Norovirus_and/or_Norovirus-like__FJ711163
MMMASKDAPTNMDGTSGAGQLVPEANTAEPISMEPVAGAATAAATAGQVNMIDPWIMNNYVQAPQGEFTISPNNTPGDVLFDLQLGPHLNPFLSHLAQMYNGWVGNMKVKVLLAGNAFTAGKIIISCIPPGFAAQNFSIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMISRDHGQMVQFQNGRVTLDGQLQGTTPTSASQLCKIRGSVFHANGGNGYNLTELDGSPYHAFESPAPIGFPDLGECDWHMEASPITQFDTGDVIKQINVKQESAFAPHLGTVQADGLSDVSANTNMIAKLGWVSPVSDGHRSDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRL

SEQ ID NO: 2555 - protein, 540 aa, Artificial Sequence
  VP1__Norovirus_and/or_Norovirus-like__FJ711164
MMMASKDAPTNMDGTSGAGQLVPEANTAEPISMEPVAGAATAAATAGQVNMIDPWIMNNYVQAPQGEFTISPNNTPGDVLFDLQLGPHLNPFLSHLAQMYNGWVGNMKVKVLLAGNAFTAGKIIISCIPPGFVAQNFSIAQATMFPHVIADVRVLEPIEVPLEDVRNVLFHNNDNTPTMRLVCMLYTPLRAGGSSSGTDPFVIAGRVLTCPSPDFSFLFLVPPNVEQKTKPFSVPNLPLNTLSNSRVPSLIKSMMISRDHGQMVQFQNGRVTLDGQLQGTTPTSASQLCKIRGSVFHANGGNGYNLTELDGSPYHAFESPAPIGFPDLGECDWHMEASPTTQFDTGDVIKQINVKQESAFAPHLGTVQADGLSDVSANTNMIAKLGWVSPVSDGHRSDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRL

SEQ ID NO: 2556 - protein, 540 aa, Artificial Sequence
  VP1__Norovirus_and/or_Norovirus-like__AF414405
MMMASKDAPPNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFDTGDVIKQINVKQESAFAPHLGTIQAGGLSDVSVNTNMIAKLGWVSPVSDGHRGNVDPWVIPRYGSTLTEAAQLAPPIYPPGFGEAIVFFMSDFPIAHGTNGLSVPFTIPQEFVTHFVNEQAPTRGEAALLYYLDPDTHRNLGEFKLYPEGFMTCVPNSSGTGPQTLPINGVFVFVSWVSRFYQLKPVGTAGPARRL

SEQ ID NO: 2557 - protein, 540 aa, Artificial Sequence
  VP1__Norovirus_and/or_Norovirus-like__AB022679
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMGFGAPAPAGFPDLGSCDWHIEMSKIPNSSTQNNPIVTNSVKPNSQQFVPHLSSITLDENVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2558 - protein, 540 aa, Artificial Sequence
  VP1__Norovirus_and/or_Norovirus-like__AF414403
MMMASKDAPPNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNTPTMRLVCMLYTPLRASGSSSGTDPFVIAGRVLTCPSPDFSLLFLVPPNVEQKTKPFSVPNLPLNTLSNSRVPSLIKSMMVSRDHGQMVQFQNGRVALDGQLQGTTPTSASQLCKIRGSVFHANGGNGYNPTELDGSPYHAFESPAPIGFPDLGECDWHMEASPTTQFDTGDVIKQINVKQESAFAPHLGTIQADGLSDVSVNTNMIAKLGWVSPVSDGHRGNVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPEGFMTCVPNSSGTGPQTLPINGVFVFVSWVSRFYQLKPVGTAGPARRL

SEQ ID NO: 2559 - protein, 540 aa, Artificial Sequence
  VP1__Norovirus_and/or_Norovirus-like__LC101821
MMMASKDAAPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPVGFPDLGSCDWHIEMSKIPNSSTQSNPIVVNSVKPNSQQFVPHLSSITLDDNVSSGGDYIGTIQWTSPPSGSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2560 - protein, 540 aa, Artificial Sequence
  VP1__Norovirus_and/or_Norovirus-like__AY038598
MMMASKDAPPNMDGTSGAGQLVPEANTAEPISMEPVAGAATAAATAGQVNMIDPWIMDNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLDPIEVPLEDVGNVLFHNNGDTPTMRLVCMLYTPLRASGSSSGTDPFVIAGHVLTCPSPDFSFLFLGPPNVEQKTKPFSVPNLPLNTLSNSRVPSLIRSMMVSRDHGQMVQFQNGRVTLDGQLQGTTPTSASQLCKIRGSVFHANGGNGYTLTELDGSPYHAFESPAPIGFPDLGECDWHMEASPTTQFDTGDVIKQINVKQEAAFAPHLGTIQADGLSDVSVNTNMIAKLGWVSPASDGHRGNVDPWVIPRYGSTLTEAAQLAPPIYPPGFGEAIVFFMSDFPIAHGANGLSVPCTIPQEFVTHFVNEQAPTRGEAALLHYLDPDTHRNLGEFKLYPEGFMTCVPNSSGTGPQTLPINGVFVFVSWVSRFYQLKPVGTAGPARSL

SEQ ID NO: 2561 - protein, 540 aa, Artificial Sequence
  VP1__Norovirus_and/or_Norovirus-like__KJ196292
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFVAQNVSIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNTLSNSRVPSLIKSMMVSRDHGQMVQFQNGRVTLDGQLQGTTPTSASQLCKIRGSVFHANGGNGYNLTELDGSPYHAFESPAPIGFPDLGECDWHMEASPTTQFNTGDVIKQINVKQESAFAPHLGTIQADGLSDVSVNTNMIAKLGWVSPVSDGHKGDVDPWVIPRYGSTLTEAAQLAPPIYPPGFGEAIVFFMSDFPIAHGTNGLSVPCTIPQEFVTHFVNEQAPTRGEAALLHYLDPDTHRNLGEFKLYPDGFMTCVPNSSGTGPQTLPINGVFVFVSWVSRFYQLKPVGTAGPARRL

SEQ ID NO: 2562 - protein, 540 aa, Artificial Sequence
  VP1__Norovirus_and/or_Norovirus-like__JQ743331
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEMSKIPNSSTQSNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2563 - protein, 540 aa, Artificial Sequence
  VP1__Norovirus_and/or_Norovirus-like__EF547394
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEVSKIPNSSTQSNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2564 - protein, 540 aa, Artificial Sequence
  VP1__Norovirus_and/or_Norovirus-like__AF394960
MMMASKDATPSADGATGAGQLVPEVNTAGPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEMSKIPNSSTQSNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2565 - protein, 540 aa, Artificial Sequence
  VP1__Norovirus_and/or_Norovirus-like__AJ277616
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTKLDGSPFMAFAAPAPAGFPNLGSCDWHIEMSKIPNSSTQSNPIVVNSVKPNSQQFVPHLSSITLDENVSSGGDYIGTIQWTSPPSDSGGANTNFWKIPDYGSSLAEASQLAPAVYPLVFNEVIVYFMACIRGPNQCGSPNLVPCLSPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2566 - protein, 540 aa, Artificial Sequence
  VP1__Norovirus_and/or_Norovirus-like__GQ413970
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2567 - protein, 540 aa, Artificial Sequence
  VP1__Norovirus_and/or_Norovirus-like__KT732281
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEVSKIPNSSTQGNPIVVNSVKPNSQQFVPHLSSITLDDNVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2568 - protein, 540 aa, Artificial Sequence
  VP1__Norovirus_and/or_Norovirus-like__AF414404
MMMASKDATPSADGATGAGQLVPEVNTADPIPIDPVAGSSTALATAGRVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLHHNNDTQPTMRLLCMLYTPLRTGGASGGTDSFVVSGRVLTCPGPDFNFLFLVPPTVEQKTRPFTVPNIPLKCLSNSRIPNPIEGMSLSPDQTQNVQFQNGRCTIDGQPLGTTPVSVSQLCKFRGRITSGQGVLNLTELDGSPFMAFAAPAPAGFPDLGSCDWHIEMSKIPNSSTQNNPIVVNSVKPNSQQFVPHLSSITLDENVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2569 - protein, 540 aa, Artificial Sequence
  VP1__Norovirus_and/or_Norovirus-like__AF414402
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICRVPPGFQSRTLSIAQATLFPHVIADVRTLDPVEVPLEDVRNVLYHNNDTQPTMRLLCMLYTPLRTGGASGGTDSFVVVGRVLTCPGPDFNFLFLVPPTVEQKTRPFTAPNIPLKYLSNSRIPNPIEGMSLSPDQTQNVQFQNGRCTIDGQPLGATPVSVSQLCKFRGRITSGQRALNLTELDGSPFMAFAAPAPAGFPDLGSCDWHIEMSKIPNSSTQNNPIVVNSVKPNSQQFVPHLPSITLDENVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2570 - protein, 540 aa, Artificial Sequence
  VP1__Norovirus_and/or_Norovirus-like__AJ313030
MMMASKDATPSADGALGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQSGRCTIDGQPLGTTPVSVSQLCKFRGRITSGQKVLNLTGLDGSPFMAFAAPAPAGFPDLGSCDWHIEMSKIPNSSTQNNPIVINSVKPNSQQFVPHLSSITLDENVLSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTRGPARGRL

SEQ ID NO: 2571 - protein, 540 aa, Artificial Sequence
  VP1__Norovirus_and/or_Norovirus-like__KM036381
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQKVLNLTELDGSPFMAFAAPAPAGFPDLGSCDWHIEMSKIPNSSTESNPIVVNSVKPNSQQFVPHLSSITLDDNVSSGGDYIGTIQWTSPPSDSGGANTNFWKIPNYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2572 - protein, 540 aa, Artificial Sequence
  VP1__Norovirus_and/or_Norovirus-like__LN854563
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVVNSVKPNSQQFVPHLSSITLDDIVSSGGDYIGTIQWTSPPSDSGGANTNFWKIPDYGSSLSEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2573 - protein, 540 aa, Artificial Sequence
  VP1__Norovirus_and/or_Norovirus-like__AB042808
MMMASKDATPSADGATGAGQLVPEVNTADPIPIDPVAGSSTALATAGQVNLIDPWIINNFVQAPQGEFTISPNNTPGDVLFDLQLGPHLNPFLSHLSQMYNGWVGNMRVRVVLAGNAFTAGKVIICCVPPGFQSRTLSIAQATLFPHVIADVRTLDPVEVPLEDVRNVLYHNNDTQPTMRLLCMLYTPLRTGGASGGTDSFVVAGRVLTCPGPDFNFLFLVPPTVEQKTRPFTVPNIPLKYLSNSRIPNPIEGMSLSPDQTQNVQFQNGRCTIDGQPLGTTPVSVSQLCKFRGRITSGQRVLNLTELDGSPFMAFAAPAPAGFPDLGSCDWHIEMSKIPNSSTQNNPIVTNSVKPNSQQFVPHLSSITLDENVSSGGDYIGTIQWTSPPSDSGGANTNFWKIPDYGSSLAEASQLAPAVYPPGFNEVIVYFMASIPGPNQSGSPNLVPCLLPQEYITHFISEQAPIQGEAALLHYVDPDTNRNLGEFKLYPGGYLTCVPNSSSTGPQQLPLDGVFVFASWVSRFYQLKPVGTAGPARGRL

SEQ ID NO: 2574 - protein, 540 aa, Artificial Sequence
  VP1__Norovirus_and/or_Norovirus-like__EU004679
MRMSDGAAPKANGSEASGQDLVPTAIEQAVPIQPVAGSALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKTGDKLKVTTFEMILGPTTNVDQAPYQGKVYASLAVAASLDLVDGRVRAVPRSIYGFQDVIPEYNDGLLVPLAPPIGPFLPGEILLRFRTYMRQLDTADAAAEAIDCALPQEFISWFASNAFTVQADALLLRYRNTLTGQLLFECKLYSEGYIALSYSGSAPLTFPTDGFFEVVSWVPRLFQLASVGSLTTGRTLK

SEQ ID NO: 2575 - protein, 540 aa, Artificial Sequence
  VP1__Norovirus_and/or_Norovirus-like__EU004678
MRMSDGAAPKANGSEASGQDLVPTAVEQAVPIQPVAGSALAAPAAGQINQIDPWIFQNFVQCPLGEFSISPRNTPGEILFDLALGPGLNPYLAHLSAMYTGWVGNMEVQLVLAGNAFTAGKVVVALVPPYFPKGSLTTAQITCFPHVMCDVRTLEPIQLPLLDVRRVLWHATQDQEESMRLVCMLYTPLRTNSPGDESFVVSGRLLSKPAADFNFVYLTPPIERTIYRMVDLPVLQPRLCTHARWPAPIYGLLVDPSLPSNPQWQNGRVHVDGTLLGTTPVSGSWVSCFAAEAAYEFQSGTGEVATFTLIEQDGSAYVPGDRAAPLGYPDFSGQLEIEVQTETTKTGDKLKVTTFEMILGPTTNVDQAPYQGRVYASLTAVASLDLVDGRVRAVPRSIYGFQDVIPEYNDGLLVPLAPPIGPFLPGEVLLRFRTYMRQLDTADAAAEAIDCALPQEFISWFASNAFTVQSDALLLRYRNTLTGQLLFECKLYSEGYIALSYSGSGPLTFPTDGFFEVVSWVPRLFQLASVGSLTTGRTLK

SEQ ID NO: 2576 - protein, 540 aa, Artificial Sequence
  VP1__Norovirus_and/or_Norovirus-like__AB281085
MKMASNDAAPSTDGAAGLVPESNNEVMALEPVAGAALAAPVTGQTNIIDPWIRANFVQAPNGEFTVSPRNAPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHIASGHNEPANRGHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGNPAIDCLLPQEWVQHFYQESAPSMSEVALVRYINPDTGRALFEAKLHRAGFMTVSSNTSAPVVVPANGYFRFDSWVNQFYSLAPMGTGNGRRR

SEQ ID NO: 2577 - protein, 540 aa, Artificial Sequence
  VP1__Norovirus_and/or_Norovirus-like__AB662868
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNEHLYNVTIINLNGSPFDPSEDIPAPLGVPDFQGRVFGVISQRDKHNTPGHNEPANRAHDAVVPTYTAQYTPKLGQIQIGTWQTDDLTNNQPVKFTPVGLNDTEHFDQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2578 - protein, 540 aa, Artificial Sequence
  VP1__Norovirus_and/or_Norovirus-like__AB662861
MKMASNDAVPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNEHLYNVTITNLNGSPFDPSEDIPAPLGVPDFQGRVFGVISQRDKHNTPGHNEPANRAHDAVVPTYTAQYTPKLGQVQIGTWQTDDLTDNQPVKFTPVGLNDTEHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2579 - protein, 540 aa, Artificial Sequence
  VP1__Norovirus_and/or_Norovirus-like__LC145791
MKMASNDVAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2580 - protein, 540 aa, Artificial Sequence
  VP1__Norovirus_and/or_Norovirus-like__LC145790
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2581 - protein, 540 aa, Artificial Sequence
  VP1__Norovirus_and/or_Norovirus-like__LC145793
MKMASNDAAPSTDGAAGLVPESNNEVMALEPVAGVALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFEGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2582 - protein, 540 aa, Artificial Sequence
  VP1__Norovirus_and/or_Norovirus-like__LC145792
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVLPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2583 - protein, 540 aa, Artificial Sequence
  VP1__Norovirus_and/or_Norovirus-like__LC145797
MKMASNDAAPSTDGAAGLVPESNNEVMALEPVAGVALAAPVTGQTNIIDPWIRANFVPAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKLFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNISGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2584 - protein, 540 aa, Artificial Sequence
  VP1__Norovirus_and/or_Norovirus-like__LC145808
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNAPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2585 - protein, 540 aa, Artificial Sequence
  VP1__Norovirus_and/or_Norovirus-like__LC145801
MKMASNDAAPSTDGAAGLVPESTNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGAPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2586 - protein, 540 aa, Artificial Sequence
  VP1__Norovirus_and/or_Norovirus-like__AB662884
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2587 - protein, 540 aa, Artificial Sequence
  VP1__Norovirus_and/or_Norovirus-like__LC145802
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGHAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFEFTYLVPPTVESKTKPFTLPILTLGELSNSRFPVSIDQMYTSPNEVISVQCQNGRCTLDGELQGTTQLQASGICAFKGEVTAHLHDNDHLYNVTITNLNGSPFDPSEDIPAPLGVPDFQGRVFGVISQRDKHNAPGHNEPANRAHDAVVPTYTAQYTPKLGQIQIGTWQTDDLTVNQPVKFTPVGLNDTDHFDQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2588 - protein, 540 aa, Artificial Sequence
  VP1__Norovirus_and/or_Norovirus-like__AB662897
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTSAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2589 - protein, 540 aa, Artificial Sequence
  VP1__Norovirus_and/or_Norovirus-like__AB662899
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2590 - protein, 540 aa, Artificial Sequence
  VP1__Norovirus_and/or_Norovirus-like__AB662894
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPANFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2591 - protein, 540 aa, Artificial Sequence
  VP1__Norovirus_and/or_Norovirus-like__LC145803
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSSFDPSEDIPAPLGIPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2592 - protein, 540 aa, Artificial Sequence
  VP1__Norovirus_and/or_Norovirus-like__AB662889
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKSFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPVGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2593 - protein, 540 aa, Artificial Sequence
  VP1__Norovirus_and/or_Norovirus-like__AB662876
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVNFTPAGLSDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRRR

SEQ ID NO: 2594 - protein, 539 aa, Artificial Sequence
  VP1__Norovirus_and/or_Norovirus-like__KU555841
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYSNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAQINQRDRWHMQLQNLNGTTYDPTDDVPAPLGTPDFKGVVFGMVSQRNVGSDAPGSTRAQQAWVSTYSPQFVPKLGSVNLRISDNDDFQFQPTKFTPVGVNDDDGHPFRQWELPNYSGELTLNMNLAPPVAPNFPGEQLLFFRSFVPCSGGYNQGIIDCLIPQEWIQHFYQESAPSQSDVALIRYVNPDTGRTLFEAKLHRSGYITVAHSGDYPLVVPANGHFRFDSWVNQFYSLAPMGTGNGRRRAQ

SEQ ID NO: 2595 - protein, 539 aa, Artificial Sequence
  VP1__Norovirus_and/or_Norovirus-like__GQ856468
MKMASNDAAPSNDGATGLVPEINTETLPLEPVAGAAIAAPVTGQNNIIDPWIRNNFVQAPNGEFTVSPRNSPGEILMNLELGPDLNPYLAHLSRMYNGYAGGVEVQVLLAGNAFTAGKILFAAVPPNFPVDMLSPAQITMLPHLIVDVRTLEPIMIPLPDVRNVFYHFNNQPAPRMRLVAMLYTPLRSNGSGDDVFTVSCRVLTRPTPDFEFTYLVPPSVESKTKPFTLPILTIGELTNSRFPAPIDQLYTSPNADIVVQPQNGRCTLDGELQGTTQLLTTAICSYRGMTSNPTSDYWDDHLLHLVHPNGATYDPTEDVPAPFGTQDFRGILYGMLTQNPRTSGDEAANSHGIYISSTSEKFTPKLGTIGLHQVQGRHSQHQQSKFTPVGIAVNGNTPFRQWELPNYSGALTLNTNLAPAVGPNFPGEQILFFRSNVPSVQGGQPIEIDCLIPQEWVSHFYQESAPSQSDVALVRYVNPDTGRTIFEAKLHRQGFITIAATGSNPVVVPPNGYFRFDSWVNQFYALAPMGTGNGRRRVQ

SEQ ID NO: 2596 - protein, 539 aa, Artificial Sequence
  VP1__Norovirus_and/or_Norovirus-like__AB684681
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPANRMRLVAMLYTPLRSNGSGDDVFTVSCRVLTRPTPDFEFTYLVPPSVESKTKPFSLPILTLSELTNSRFPAPIDSLFTAQNNVLQVQCQNGRCTLDGELQGTTQLLPTGICAFRGRVTAETDNPDKWHMQLQNLNGTTYDPTDDVPAPLGTPDFRGLLFGVASQRNVGNDAPGSTRAHEVVISTTSPQFVPKLGSINFRSTSEDFRTGQPTRFTPVGINDEDNHPFNQWELPDYSGRLTLNMNLAPPVAPNFPGEQLLFFRSNVPCSGGYNQGIIDCLIPQEWIQHFYQESAPSQSEVALIRYVNPDTGRTLFEAKLHRTGYITVAHSGDYPLVVPANGYFRFDSWVNQFYSLAPMGTGNGRRRAQ

SEQ ID NO: 2597 - protein, 539 aa, Artificial Sequence
  VP1__Norovirus_and/or_Norovirus-like__AB809988
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRR

SEQ ID NO: 2598 - protein, 539 aa, Artificial Sequence
  VP1__Norovirus_and/or_Norovirus-like__AB810011
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGRR

SEQ ID NO: 2599 - protein, 539 aa, Artificial Sequence
  VP1__Norovirus_and/or_Norovirus-like__AB809994
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLQRQDAFIDCLLPQEWVNHFYQEAAPSQADVALIRYVNPDTGRTLFEAKLHRSGFITVSHTGAYPLVVPPNGHFRFDSWVNQFYSLAPMGTGNGRR

SEQ ID NO: 2600 - protein, 539 aa, Artificial Sequence
  VP1__Norovirus_and/or_Norovirus-like__KX767083
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSIPVLTVEEMTNSRFPIPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRADGSTRGHKATVYTGSADFAPKLGRVQFGTDTSNDFEANQNTKFTPVGVIQDGDTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRRV

SEQ ID NO: 2601 - protein, 539 aa, Artificial Sequence
  VP1__Norovirus_and/or_Norovirus-like__LN854565
MKMASNDANPSDGSAANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTIPILTVEEMTNSRFPIPLEKLYTGPSSAFVVQPQNGRCTTDGVLLGTTQLSPVNICTFRGDVTNIQGSHTYTMNLASLNWNNYDPTEETPAPLGTPDFVGKIQGVLTQTTKGQGSTRGHKATVYTGSASFTPKLGSVQFRTDTQNDFVTHQNTKFTPVGVIQDGDTTHRNEPQQWVLPNYSGVNTHNVHLAPAVAPTIPGEQLLFFRSSMPGCSGYPNMDLDCLVPQEWVQHFYQEAAPALSDVALLRFVNPDTGRVLFECKLHKSGYVTVAHTGHHDLVIPPNGYFRFDSWVNQFYTLAPMGNGTGRRRV

SEQ ID NO: 2602 - protein, 539 aa, Artificial Sequence
  VP1__Norovirus_and/or_Norovirus-like__KX354071
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQNGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2603 - protein, 539 aa, Artificial Sequence
  VP1__Norovirus_and/or_Norovirus-like__AB933688
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFEIHQNTKFTPVGVIQDGSTTHRNEPQQWVLPSYSGRDAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2604 - protein, 539 aa, Artificial Sequence
  VP1__Norovirus_and/or_Norovirus-like__GQ845337
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRRV

SEQ ID NO: 2605 - protein, 539 aa, Artificial Sequence
  VP1__Norovirus_and/or_Norovirus-like__JX155747
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2606 - protein, 539 aa, Artificial Sequence
  VP1__Norovirus_and/or_Norovirus-like__JX155737
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2607 - protein, 539 aa, Artificial Sequence
  VP1__Norovirus_and/or_Norovirus-like__KX354055
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2608 - protein, 539 aa, Artificial Sequence
  VP1__Norovirus_and/or_Norovirus-like__KX353957
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVFTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2609 - protein, 539 aa, Artificial Sequence
  VP1__Norovirus_and/or_Norovirus-like__KF509947
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSRNYTMNLASQNWNNYDPTEEIPAPLGTPDFVGKIQGVLTQTTRADGSTRGHKAIVYTGSADFAPKLGRVQFETDTDHDFEANQNTKFTPVGVTQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2610 - protein, 539 aa, Artificial Sequence
  VP1__Norovirus_and/or_Norovirus-like__AB504326
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2611 - protein, 539 aa, Artificial Sequence
  VP1__Norovirus_and/or_Norovirus-like__KX354056
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRADGSTRGHKATVYTGSADFAPKLGRVQFGTDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKLGYVTVAHTGQHDLVIPPNGYFRFDSWVNQFYTLAPMGNGTGRRRV

SEQ ID NO: 2612 - protein, 539 aa, Artificial Sequence
  VP1__Norovirus_and/or_Norovirus-like__AB541255
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2613 - protein, 539 aa, Artificial Sequence
  VP1__Norovirus_and/or_Norovirus-like__KP784696
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGEIQGVLTQTTRTDGSTRGHKATVYTGSADFAPKLGRIQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPSQSDVALLRFVNPDTGRVLFECKLHKSGYVTVAHTGQHDLVIPPNGYFRFDSWVNQFYTLAPMGNGTGRRRV

SEQ ID NO: 2614 - protein, 539 aa, Artificial Sequence
  VP1__Norovirus_and/or_Norovirus-like__KX354042
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSSVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2615 - protein, 539 aa, Artificial Sequence
  VP1__Norovirus_and/or_Norovirus-like__KX354007
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEVPAPLGTPDFVGKIQGMLTQTTRTDGSTRGHKATVYTGSADFTPKLGRIQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2616 - protein, 539 aa, Artificial Sequence
  VP1__Norovirus_and/or_Norovirus-like__KT780393
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLTPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2617 - protein, 539 aa, Artificial Sequence
  VP1__Norovirus_and/or_Norovirus-like__KX354043
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTYNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2618 - protein, 539 aa, Artificial Sequence
  VP1__Norovirus_and/or_Norovirus-like__KX354008
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEVPAPLGTPDFVGKIQGMLTQTTRTDGSTRGHKATVYTGSADFTPKLGRIQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRRV

SEQ ID NO: 2619 - protein, 539 aa, Artificial Sequence
  VP1__Norovirus_and/or_Norovirus-like__KR904217
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCSTDGVLLGTTQLSPVNICTFRGDVTHIAGSHNYTMNLASQNWSSYDPTEEIPAPLGTPDFVGKIQGVLTQTTRSDGSTRGHKATVYTGSADFSPKLGRVQFATDTDNDFVSNQNTKFTPVGVIQDGDTAHRNEPQQWVLPSYSGRNIHNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNHFYTLAPMGNGTGRRRV

SEQ ID NO: 2620 - protein, 539 aa, Artificial Sequence
  VP1__Norovirus_and/or_Norovirus-like__KJ685412
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFATDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2621 - protein, 539 aa, Artificial Sequence
  VP1__Norovirus_and/or_Norovirus-like__KF008240
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEVNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2622 - protein, 539 aa, Artificial Sequence
  VP1__Norovirus_and/or_Norovirus-like__KX354125
MKMASSDANPSDGSAANLVPEANNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRADGSTRGHKATVYTGSADFSPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRV

SEQ ID NO: 2623 - protein, 539 aa, Artificial Sequence
  VP1__Norovirus_and/or_Norovirus-like__KX354094
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2624 - protein, 539 aa, Artificial Sequence
  VP1__Norovirus_and/or_Norovirus-like__KX354058
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNNYDPTEEIPAPLGTPDFVGKIQGMLTQTTRTDGSTRGHKATVYTGSAEFAPKLGRVQFETDTDHDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2625 - protein, 539 aa, Artificial Sequence
  VP1__Norovirus_and/or_Norovirus-like__KX354057
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSAEFAPKLGRVQFETDTDHDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2626 - protein, 539 aa, Artificial Sequence
  VP1__Norovirus_and/or_Norovirus-like__KX354034
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2627 - protein, 539 aa, Artificial Sequence
  VP1__Norovirus_and/or_Norovirus-like__KX354027
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRV

SEQ ID NO: 2628 - protein, 539 aa, Artificial Sequence
  VP1__Norovirus_and/or_Norovirus-like__KX354025
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRADGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2629 - protein, 539 aa, Artificial Sequence
  VP1__Norovirus_and/or_Norovirus-like__KJ685406
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2630 - protein, 539 aa, Artificial Sequence
  VP1__Norovirus_and/or_Norovirus-like__KF008241
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVSICTFRGDVTHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2631 - protein, 539 aa, Artificial Sequence
  VP1__Norovirus_and/or_Norovirus-like__AB504327
MKMASNDANPSDGSAANLVPEVNNEVMALEPVVGAAIAAPVAGQQNVIDPWIRNNFVQAPGGEFTVSPRSAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTRFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2632 - protein, 539 aa, Artificial Sequence
  VP1__Norovirus_and/or_Norovirus-like__KY424329
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICNFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2633 - protein, 539 aa, Artificial Sequence
  VP1__Norovirus_and/or_Norovirus-like__KT780389
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGVLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRKRV

SEQ ID NO: 2634 - protein, 539 aa, Artificial Sequence
  VP1__Norovirus_and/or_Norovirus-like__KX354134
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSHNYTMNLASQNWNSYDPTEEIPAPLGTPDFVGKIQGVLTQTTRADGSTRGHKATVYTGSADFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQFFYQEAAPAQSDVALLRFVNPDTGRVLFECKLHKSGYVTVAHTGQHDLVIPPNGYFRFDSWVNQFYTLAPMGNGTGRRRV

SEQ ID NO: 2635 - protein, 539 aa, Artificial Sequence
  VP1__Norovirus_and/or_Norovirus-like__KX354126
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRADGSTRGHKATVYTGSADFSPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRV

SEQ ID NO: 2636 - protein, 539 aa, Artificial Sequence
  VP1__Norovirus_and/or_Norovirus-like__KR904237
MKMASSDANPSDGSAANLVPEVNNEVMALEPVVGAAIAAPVAGQQNVIDPWIRDNFVQAPGGEFTVSPRNAPGEILWSAPLGPDLNPYLSHLARMYNGYAGGFEVQVILAGNAFTAGKVIFAAVPPNFPTEGLSPSQVTMFPHMIVDVRQLEPVLIPLPDVRNNFYHYNQSNDPTLKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRI

SEQ ID NO: 2637 - protein, 539 aa, Artificial Sequence
  VP1__Norovirus_and/or_Norovirus-like__KP241911
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2638 - protein, 539 aa, Artificial Sequence
  VP1__Norovirus_and/or_Norovirus-like__KJ685411
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASLNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2639 - protein, 539 aa, Artificial Sequence
  VP1__Norovirus_and/or_Norovirus-like__KF008242
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKRV

SEQ ID NO: 2640 - protein, 539 aa, Artificial Sequence
  VP1__Norovirus_and/or_Norovirus-like__KF060112
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2641 - protein, 539 aa, Artificial Sequence
  VP1__Norovirus_and/or_Norovirus-like__JX126912
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVIQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2642 - protein, 539 aa, Artificial Sequence
  VP1__Norovirus_and/or_Norovirus-like__KX354143
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKAIVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2643 - protein, 539 aa, Artificial Sequence
  VP1__Norovirus_and/or_Norovirus-like__KU985164
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRRV

SEQ ID NO: 2644 - protein, 539 aa, Artificial Sequence
  VP1__Norovirus_and/or_Norovirus-like__KX950760
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSIPVLTVEEMTNSRFPIPLERLFTGPSSAFVVQPQNGRCTTDGVLLGTTQLSPVNICTFRGDVTHITGSRNYTMNLASQNWNNYDPTEEIPAPLGTPDFVGKIQGMLTQTTRANGSTRGHKATVYTGSADFAPKLGRVQFETDTSDDFETSQNTKFTPVGVIQDGSTTPRNEPQQWVLPSYSGRNTHNVHLAPAVAPTFPGEQLLFFRSIMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRRV

SEQ ID NO: 2645 - protein, 539 aa, Artificial Sequence
  VP1__Norovirus_and/or_Norovirus-like__KJ685402
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSGAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2646 - protein, 539 aa, Artificial Sequence
  VP1__Norovirus_and/or_Norovirus-like__KF060140
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDIRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2647 - protein, 539 aa, Artificial Sequence
  VP1__Norovirus_and/or_Norovirus-like__KX354132
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHTTGSHNYTMNLASQNWNSYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQFFYQEAAPAQSDVALLRFVNPDTGRVLFECKLHKSGYVTVAHTGQHDLVIPPNGYFRFDSWVNQFYTLAPMGNGTGRRRV

SEQ ID NO: 2648 - protein, 539 aa, Artificial Sequence
  VP1__Norovirus_and/or_Norovirus-like__KX354006
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEVPAPLGTPDFVGKIQGMLTQTTRTDGSTRGHKATVYTGSADFTPKLGRIQFETDTDHDFEANQNTKFTPVGVIQDGSTTHRNEPQQWVLPSYSGRNTHNVHLASAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRRV

SEQ ID NO: 2649 - protein, 539 aa, Artificial Sequence
  VP1__Norovirus_and/or_Norovirus-like__KX354145
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2650 - protein, 539 aa, Artificial Sequence
  VP1__Norovirus_and/or_Norovirus-like__KX354140
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLATPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2651 - protein, 539 aa, Artificial Sequence
  VP1__Norovirus_and/or_Norovirus-like__KX354119
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSHNYTMNLASQNWNSYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQFFYQEAAPAQSDVALLRFVNPDTGRVLFECKLHKPGYVTVAHTGQHDLVIPPNGYFRFDSWVNQFYTLAPMGNGTGRRRV

SEQ ID NO: 2652 - protein, 539 aa, Artificial Sequence
  VP1__Norovirus_and/or_Norovirus-like__KX354018
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFGANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2653 - protein, 539 aa, Artificial Sequence
  VP1__Norovirus_and/or_Norovirus-like__AB972499
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2654 - protein, 539 aa, Artificial Sequence
  VP1__Norovirus_and/or_Norovirus-like__KF060142
MKMASSDANPSDGSAANLVPEVNNEVMALDPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2655 - protein, 539 aa, Artificial Sequence
  VP1__Norovirus_and/or_Norovirus-like__KF060138
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2656 - protein, 539 aa, Artificial Sequence
  VP1__Norovirus_and/or_Norovirus-like__KP784697
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAADPPNFPTEGLSPSQVTMFPHMIVDVRQLEPVLIPLPDVRNNFYHYNQSNDPTLKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2657 - protein, 539 aa, Artificial Sequence
  VP1__Norovirus_and/or_Norovirus-like__KF060111
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2658 - protein, 539 aa, Artificial Sequence
  VP1__Norovirus_and/or_Norovirus-like__KF060089
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2659 - protein, 539 aa, Artificial Sequence
  VP1__Norovirus_and/or_Norovirus-like__KP096333
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFIVQPQNGRCTTDGVLLGTTQLSPVNICTFRGDVTHISGSRNYTMNLASQNWNSYDPTEETPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRRV

SEQ ID NO: 2660 - protein, 539 aa, Artificial Sequence
  VP1__Norovirus_and/or_Norovirus-like__KF060153
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2661 - protein, 539 aa, Artificial Sequence
  VP1__Norovirus_and/or_Norovirus-like__KF060125
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVEVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGTLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2662 - protein, 539 aa, Artificial Sequence
  VP1__Norovirus_and/or_Norovirus-like__KX354135
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSHNYTMNLASQNWNSYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTHNVHLAPAVAPTFPGEQLLFLKSTMPGCSGYPNMDLDCLLPQEWVQFFYQEAAPAQSDVALLRFVNPDTGRVLFECKLHKSGYVTVAHTGQHDLVIPPNGYFRFDSWVNQFYTLAPMGNGTGRRRV

SEQ ID NO: 2663 - protein, 539 aa, Artificial Sequence
  VP1__Norovirus_and/or_Norovirus-like__KX354045
MKMASSDANPSDGSAANLVPDVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2664 - protein, 539 aa, Artificial Sequence
  VP1__Norovirus_and/or_Norovirus-like__LC153121
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2665 - protein, 539 aa, Artificial Sequence
  VP1__Norovirus_and/or_Norovirus-like__KF668568
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAIPPNFPTEGLSPSQVTMFPHIVVDVRQLEPVLIPLPDVRNNFYHYNQSNDPTIKLIAMLYTPLRANNAGGDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQITKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2666 - protein, 539 aa, Artificial Sequence
  VP1__Norovirus_and/or_Norovirus-like__KF668567
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVSTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2667 - protein, 539 aa, Artificial Sequence
  VP1__Norovirus_and/or_Norovirus-like__KR904210
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLETPDFVGKIQGVLTQTTRTDGSTRGHKATVYTGSADFSPKLGRVQFATDTDNDFDSNQNTKFTPVGVIQDGGTTHRNEPQQWVLPSYSGRDIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2668 - protein, 539 aa, Artificial Sequence
  VP1__Norovirus_and/or_Norovirus-like__JX459907
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTDEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2669 - protein, 539 aa, Artificial Sequence
  VP1__Norovirus_and/or_Norovirus-like__KF060062
MKMASSDANPTDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2670 - protein, 539 aa, Artificial Sequence
  VP1__Norovirus_and/or_Norovirus-like__KF060080
MKMASSDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2671 - protein, 539 aa, Artificial Sequence
  VP1__Norovirus_and/or_Norovirus-like__KF378731
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFAAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTLRGDVTHITGSRNYTMNLASQNWNNYDPTEEIPAPLGTPDFVGKIQGMLTQTTRTDGSTRGYKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2672 - protein, 539 aa, Artificial Sequence
  VP1__Norovirus_and/or_Norovirus-like__AB933731
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSKVSPIPLKKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2673 - protein, 539 aa, Artificial Sequence
  VP1__Norovirus_and/or_Norovirus-like__AB933749
MKMASNDVNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAVVRIIFSAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2674 - protein, 539 aa, Artificial Sequence
  VP1__Norovirus_and/or_Norovirus-like__KC517370
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPSNFPTEGLSPSQVTMFPHIIVDVRQLEPVLIPLPDVRNNFYHYNQSNDSTIKLIAMLYTLLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATMYTGSADFAPKLGRVQFETDTDHDFEANQNTKFTPVGVIQDGGTTHRNEPQQWVLPSYSGRNTHNVHLAPAVAPTFPGEQLLFFRPTMPGCSGYPNMDLDRLLPQEWVQYFYQEAAPAQSDVALLRFVNPDTGRVLFECKLHKSGYVTVAHTGQHDLVIPPNGYFRFDSWVNQFYTLAPMGNGTGRRRV

SEQ ID NO: 2675 - protein, 539 aa, Artificial Sequence
  VP1__Norovirus_and/or_Norovirus-like__EF547396
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEVPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDTDYSPNTSIICTLDWLSQTTGQSNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRL

SEQ ID NO: 2676 - protein, 539 aa, Artificial Sequence
  VP1__Norovirus_and/or_Norovirus-like__JN699047
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDHDYDPNTSIICTLDWLSQTTGQNNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRL

SEQ ID NO: 2677 - protein, 539 aa, Artificial Sequence
  VP1__Norovirus_and/or_Norovirus-like__KT781411
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFASQNISIAQATMFPHVIADVRVLEPIEVPLEDVRNVLFHNNDNSPTMRLVCMLYTPLRASGSSSGTDPFVIAGRVLTCPSPDFSFLFLVPPNVEQKTKPFSVPNLPLNTLSNSRVPSLINAMMISRDHGQMVQFQNGRVTLDGQLQGTTPTSLSQLCKIRGKVFLASGGNGLNLTELDGSAYHAFESPAPIGFPDIGDCDWHMNATATSNFTGSNDEHQILVKQESTFAPHLGHVQADHLPEVANTDLMVSLSWISPVSDQHRRDVDPWVIPRYGSTLTEAAQLAPPIYPPGFGEAIVFFMSDFPVVSGVNGMRIPCTLPQEYVAHFVNEQAPTRGEAALLHYVDPDTHRNLGEFKIYPEGFMTCVPNSSGTGPQTLPINGVFTFVSWVSRFYQLKPVGTAGPARRL

SEQ ID NO: 2678 - protein, 539 aa, Artificial Sequence
  VP1__Norovirus_and/or_Norovirus-like__U04469
MMMASKDAPTNMDGTSGAGQLVPEANTAEPISMEPVAGAATAAATAGQVNMIDPWIMSNYVQAPQGEFTISPNNTPGDILFDLQLGPHLNPFLSHLAQMYNGWVGNMRVKVLLAGNAFTAGKIIISCIPPGFAAQNISIAQATMFPHVIADVRVLEPIEVPLEDVRNVLFHNNDSSPTMRLVCMLYTPLRASGSSSGTDPFVIAGRVLTCPSPDFSFLFLVPPNVEQKTKPFSVPNLPLNTLSNSRVPSLINAMMISRDHGQMVQFQNGRVTLDGQLQGTTPTSLSQLCKIRGKVFHASGGNGLNLTELDGSAYHAFESPAPIGFPDIGDCDWHMSATATNNFTGSSNEYQILIKQESAFAPHLGHVQADNLSAGANTDLIVSLSWISPVSDQHRHDVDPWVIPRYGSSLTEAAQLAPPIYPPGFGEAIVFFMSDFPVVSGVNGMRIPCTLPQEYVAHFVNEQAPTRGEAALLHYVDPDTHRNLGEFKMYPEGFMTCVPNSSGSGPQTLPINGVFTFVSWVSRFYQLKPVGTAGPARRL

SEQ ID NO: 2679 - protein, 539 aa, Artificial Sequence
  VP1__Norovirus_and/or_Norovirus-like__JN699049
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFASQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNVLSNSRVPSLIKFMMVSQDHGQMVQFQNGRVTLDGQLQGTTPTSASQLCKMRGTVYHASGGQGLNLTEIDGTPYHAFESPAPIGFPDLGDSDWHINASPATTFNTGESVKRLDMEQGSSFAPHLGTVHYTNADYDANTDLICSLEWLSPPSGGTPNKVNPWAIPRYGSTLTEAAQLAPPIYPPGFGEAIVFFMSDFPIANGQDGLKVPCTIPQEFVTHFVNEQAPTRGEAALLHYVDPDTHRNLGEFKLYPEGFMTCVPNSSGSGPQTLPINGVFTFVSWVSRFYQLKPVGTTGPVRRL

SEQ ID NO: 2680 - protein, 539 aa, Artificial Sequence
  VP1__Norovirus_and/or_Norovirus-like__GQ856473
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFAAQNISIAQATMFPHVIADVRVLEPIEVPLEDVRNVLFHNNDNSPTMRLVCMLYTPLRASGSSSGTDPFVIAGRVLTCPSPDFSFLFLVPPNVEQKTKPFSVPNLPLNTLSNSRVPSLINAMMISRDHGQMVQFQNGRVTLDGQLQGTTPTSLSQLCKIRGKVFHASGGNGLNLTELDGSAYHAFESPAPIGFPDIGECDWHMNATATSNFTGSNDEYQILVKQESTFAPHLGHVQADSLSADANTDLMVSLSWISPVSDQHRRDVDPWVIPRYGSSLTEAAQLAPPIYPPGFGEAIVFFMSDFPVVSGVNGMRIPCTLPQEYVAHFVNEQAPTRGEAALLHYVDPDTHRNLGEFKMYPEGFMTCVPNSSGSGPQTLPINGVLTFVSWVSRFYQLKPVGTAGPARRL

SEQ ID NO: 2681 - protein, 539 aa, Artificial Sequence
  VP1__Norovirus_and/or_Norovirus-like__JN699050
MMMASKDAPTNMDGTSGAGQLVPEANTAEPISMEPVAGAATAAATAGQVNMIDPWIMNNYVQAPQGEFTISPNNTPGDILFDLQLGPHLNPFLSHLAQMYNGWVGNMKVKVLLAGNAFTAGKIIISCIPPGFASQNISIAQATMFPHVIADVRVLEPIEVPLEDVRNVLFHNNDNTPTMRLVCMLYTPLRASGSSSGTDPFVIAGRVLTCPSPDFSFLFLVPPNVEQKTKPFSVPNLPLNVLSNSRVPSLIKSMMVSQDHGQMVQFQNGRVTLDGQLQGTTPTSASQLCKMRGTVYHASGGQGLNLTEIDGTPYHAFESPAPIGFPDIGDSDWHINASPATTFDSGESIKRLDMEQGSSFAPHLGTVHYTNADYPANTDLICSLEWLSPPSGGTPNKVNPWTIPRYGSTLTEAAQLAPPIYPPGFGEAIVFFMSDFPIANGQDGLKVPCTIPQEFVTHFVNEQAPTRGEAALLHYVDPDTHRNLGEFKLYPEGFMTCVPNSSGSGPQTLPINGVFTFVSWVSRFYQLKPVGTTGPVRRL

SEQ ID NO: 2682 - protein, 539 aa, Artificial Sequence
  VP1__Norovirus_and/or_Norovirus-like__GQ856472
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGSGINLTELNGEPYHAFESPAPIGFPDLGGCDWHLTATPTQAFNDGAKVVRLSVTQGAAFAPHLGTIHYTTTDTDYNPNTSIICTLDWLSQTTGQSNVDPWQIPTYGSALTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRL

SEQ ID NO: 2683 - protein, 539 aa, Artificial Sequence
  VP1__Norovirus_and/or_Norovirus-like__GQ856471
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGSGINLTELNGEPYHAFESPAPIGFPDLGGCDWHLTATPTQAFNDGAKVVRLSVTQGAAFAPHLGTIHYTTTDTDYNPNTSIICTLDWLSQTTGQSNVDPWQIPTYGSTLTEAAQLAPPIFPPGFGETLVFFLSDFPISNGKNGLSVPCTLPQEFVTHFVNEQAPIRGEAALLHYADPDTHRNLGEFKLYPEGFMTCVPNTSGGGPQTLPINGVFVFVSWVSRFYQLKPVGTAGAARRL

SEQ ID NO: 2684 - protein, 539 aa, Artificial Sequence
  VP1__Norovirus_and/or_Norovirus-like__JQ911594
MMMASKDAPTNMDGTSGAGQLVPEANTAEPISMDPVAGAATAVATAGQINMIDPWIMSNFVQAPQGEFTVSPNNTPGDVLFDLQLGPQLNPFLAHLAQMYNGWVGNMRVKVLLAGNAFTAGKIIISCIPPGFTSQNISIAQMTMFPHVIADVRVLEPIEIPLEDVRNVLFHTNDNRPTMRLVCMLYTPLRANGSSSGTDPFVIAGRVLTCPDSNFSFLFLVPPNVEQKTRPFSVPNIPLNTLSNSRVPSLIKSMTISRDQNQIIQFQNGRVTLDGQLQGTTPTSVSQLCKIRGTTYHATGGNGINLTELNGEPYHAFESPAPIGFPDLGGCDWHLTATPTQAFNDGAKVVRLSVTQGAAFAPHLGTIHYTTTDTDYNPNTSIICTLDWLSQTAGQSNVDPWQIPTYGSTLTEAAQLAPPIFPPGFGETLVFFLSDFPISNGKNGLSVPCTLPQEFVTHFVNEQAPIRGEAALLHYVDPDTHRNLGEFKLYPEGFMTCVPNTSGGGPQTLPINGVFVFVSWVSRFYQLKPVGTAGAARRL

SEQ ID NO: 2685 - protein, 539 aa, Artificial Sequence
  VP1__Norovirus_and/or_Norovirus-like__GU296356
MMMASKDATSNMDGTSGAGQLVPENNNTSEPINMEPVAGAVTAAATAGQVNMIDPWIMNNYVQAPQGEFTISPNNTPGDILFDLQLGPHLNPFLAHLSQMYNGWVGNMKVRVVLAGNAFSAGKIIVCCIPPGFSAPNISIAQATMFPHVIADVRVLEPIDIPLDDVRNVLFHTNDNGNQTMRLLCMLYTPLRSGGTSSGTDPFVIAGRVLTCPTPDFNFLFLVPPTVEQKTKQFSVPNLPLNVMSNSRVPSLLNAMVVSPDQAQVVQFQNGRCTLDGQMLGTTTVSASCVARFRGKTFQAPDDRLGINLAEISGEPYHAFESPAPLGFPDFGDGDWHVTATKVAPSQLEANDPVVVGNVQPYNPQFAPHLGTLVVENPTPNQVATGTDLLFNITWLSNRANNRFNPWIIPNYGSTLTEAAQLAPSIFPPGFGETIVYFNSTFPAVGATTHAAIPCLLPQEFVAHFVNEQAPIRGEAALLHYIDPDTHRNLGEFKIYPEGFVTCVPNVGGTGPQSLPTNGIFVFVSWVSRYYQLKPVGTA

SEQ ID NO: 2686 - protein, 539 aa, Artificial Sequence
  VP1__Norovirus_and/or_Norovirus-like__KM461693
MKMASNDAAPSNDGAANLVPEANNEVMALEPVVGASIAAPVVGQQNIIDPWIRENFVQAPQGEFTVSPRNSPGEMLLNLELGPELNPYLSHLSRMYNGYAGGMQVQVVLAGNAFTAGKIIFAAVPPHFPVDNISAAQITMCPHVIVDVRQLEPVLLPLPDIRNRFFHYNQEDTPRMRLVAMLYTPLRANSGEDVFTVSCRVLTRPAPDFEFTFLVPPTVESKTKPFTLPILTLGELSNSRFPAAIDMLYTDPNESIVVQPQNGRCTLDGTLQGTTQLVPTQICAFRGTLISQNARAADLTDSPQRARNHPLHVQVKNLDGTQYDPTDDIPAVLGAIDFKGTVFGVASQRDVSGTQEQGHYATRAHEAHIDTTDPKYAPKLGTILIKSESTDFTTNQPIRFTPVGMGDNNWRQWELPDYSGSLTLNMNLAPAVSPSFPGERILFFRSIVPSAGGYGSGYIDCLIPQEWVQHFYQEAAPSQSAVALVRYVNPDTGRNIFEAKLHREGFLTVANSGNNPMGVPPNGYFRFEAWVNQFYTLAP

SEQ ID NO: 2687 - protein, 539 aa, Artificial Sequence
  VP1__Norovirus_and/or_Norovirus-like__LC145789
MKMASNDAAPSTDGAAGLVPESNNEVMALEPVAGAALAAPVTGQTNIIDPWIRANFVQAPNGEFTVSPRNSPGEVLLNLELGPELNPYLAHLARMYNGYAGGMEVQVMLAGNAFTAGKLVFAAVPPHFPVENLSPQQITMFPHVIIDVRTLEPVLLPLPDVRNNFFHYNQKDDPKMRIVAMLYTPLRSNGSGDDVFTVSCRVLTRPSPDFDFTYLVPPTVESKTKPFTLPILTLGELSNSRFPVSIDQMYTSPNEVISVQCQNGRCTLDGELQGTTQLQVSGICAFKGEVTAHLHDNDHLYNVTITNLNGSPFDPSEDIPAPLGVPDFQGRVFGVISQRDKHNTPGHNEPANRAHDAVVPTYTAQYTPKLGQIQIGTWQTDDLTVNQPVKFTPVGLNDTDHFNQWVVPRYAGALNLNTNLAPSVAPVFPGERLLFFRSYIPLKGGYGTPAIDCLLPQEWVQHFYQEAAPSMSEVALVRYINPDTGRALFEAKLHRAGFMTVSSNTSAPVVVPANGYFRFDSWVNQFYSLAPMGTGNGRR

SEQ ID NO: 2688 - protein, 538 aa, Artificial Sequence
  VP1__Norovirus_and/or_Norovirus-like__KX171417
MKMASNDAAPSNDGAAGLVPEGNNETLSLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAKTDHSDKWHMQLQNLNGTTYDPTDDVPAPLGTPDFKGVVFGVASQRNVGNDAPGSTRAHEAVISTYSPQFVPKLGSVNFRSNDDDFQLQPTKFTPVCINDDDDHPFRQWELPDYSGLLTLNMNLAPPVAPNFPGEQLLFFRSFVPCSGGYNQGIVDCLIPQEWIQHFYQESAPSQSEVALIRYVNPDTGRTLFEAKLHRSGYITVAHSGDYPLVVPANGYFRFDSWVNQFYSLAPMGTGNGRRRAQ

SEQ ID NO: 2689 - protein, 538 aa, Artificial Sequence
  VP1__Norovirus_and/or_Norovirus-like__KX171412
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHHDKWHMQLQNLNGTTYDPTDDVPAPLGTPDFKGVVFGVASQRNVGNDAPGSTRAHEAVISTYSPQFVPKLGSVNFRSNDDDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2690 - protein, 538 aa, Artificial Sequence
  VP1__Norovirus_and/or_Norovirus-like__KU557839
MKMASNDAAPSSDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGVASQRNVGNDAPGSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2691 - protein, 538 aa, Artificial Sequence
  VP1__Norovirus_and/or_Norovirus-like__KP902564
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGVASQRNVGNDAPDSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2692 - protein, 538 aa, Artificial Sequence
  VP1__Norovirus_and/or_Norovirus-like__KU587625
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHIIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDNPDKWHMQLQNLNGTTYDPTDDVPAPLGTPDFKGVVFGVASQRNVGNDAPGSTRAHEAVISTYSPKFVPKLGSVNFRSNDDDFQLQPTRFTPVGINDDGNHPFRQWELPDYSGVLTLNMNLAPPVAPNFPGEQLLLFRSFVPCSGGYNQGIIDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2693 - protein, 538 aa, Artificial Sequence
  VP1__Norovirus_and/or_Norovirus-like__KX171413
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTTETDHRDKWHMQLQNLNGTTYDPTDDVPAPLGTPDFKGVVFGVASQRNVGNDAPGSTRAHEAVISTYSPQFVPKLGSVNFRSNDDDFQLQPTKFTPVGINDDGDHPFRQWELPDYSGPLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2694 - protein, 538 aa, Artificial Sequence
  VP1__Norovirus_and/or_Norovirus-like__KP902565
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNNRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGVASQRNVGNDAPGSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2695 - protein, 538 aa, Artificial Sequence
  VP1__Norovirus_and/or_Norovirus-like__KX171416
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNNRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGIASQRNVGNDAPGSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2696 - protein, 538 aa, Artificial Sequence
  VP1__Norovirus_and/or_Norovirus-like__KU561250
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAQNNVLQVQCQNGRCTLDGELQGTTQLLPSGICAFRGRVTAETDHRDKWHMQLQNLNGTTYDPTDDVPAPLGTPDFKGVVFGVASQRNVGNDAPGSTRAHEAAISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRRAQ

SEQ ID NO: 2697 - protein, 538 aa, Artificial Sequence
  VP1__Norovirus_and/or_Norovirus-like__KU561251
MKMASNDAAPSNDGAAGLVPEGNNETLPLEPVAGAAIAAPVTGQNNIIDPWIRTNFVQAPNGEFTVSPRNSPGEILLNLELGPDLNPYLAHLSRMYNGYAGGVEVQVLLAGNAFTAGKILFAAVPPNFPVEFLSPAQITMLPHLIVDVRTLEPIMIPLPDVRNTFFHYNNQPNSRMRLVAMLYTPLRSNGSGDDVFTVSCRVLTRPTPDFEFTYLVPPSVESKTKPFSLPILTLSELTNSRFPVPIDSLFTAHNNVLQVQCQNGRCTLDGELQGTTQLLPSGICAFRGRVTAETDHRDKWHMQLQNLNGTTYDPTDDVPAPLGTPDFKGVVFGVASQRNVGNDAPGSTRAHEAVISTYSPQFVPKLGSVNFRSNDNDFQLQPTKFTPVGINDDGDHPFRQWELPDYSGLLTLNMNLAPPVAPNFPGEQLLFFRSFVPCSGGYNQGIVDCLIPQEWIQHFYQESAPSQSDVALIRYVNPDTGRTLFEAKLHRSGYITVAHSGDYPLVVPANGYFRFDSWVNQFYSLAPMGTGNGRRTAQ

SEQ ID NO: 2698 - protein, 538 aa, Artificial Sequence
  VP1__Norovirus_and/or_Norovirus-like__AB810014
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFRGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGR

SEQ ID NO: 2699 - protein, 538 aa, Artificial Sequence
  VP1__Norovirus_and/or_Norovirus-like__AB809985
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWVNQFYSLAPMGTGNGR

SEQ ID NO: 2700 - protein, 538 aa, Artificial Sequence
  VP1__Norovirus_and/or_Norovirus-like__AB810003
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANRGDNWDQNLLQLTYPSGASYDPTDEVPAPLGTQDFSGILYGVLTQDNVSEGTGEAKNAKGVYISTTSGKFTPKIGSIGLHSITENVHPNQQSRFTPVGVAQNENTPFQQWVLPHYAGALALNTNLAPAVAPTFPGEQLLFFRSRVPCVQGLRGQDAFIDCLLPQEWVNHFYQEAAPSQADVALIRYVNPDTGRTLFEAKLHRSGFITVSHTGAYPLVVPPNGHFRFDSWFNQFYSLAPMGTGNGR

SEQ ID NO: 2701 - protein, 538 aa, Artificial Sequence
  VP1__Norovirus_and/or_Norovirus-like__AB809975
MKMASNDAAPSNDGAASLVPEAINETMPLEPVAGASIAAPVAGQTNIIDPWIRTNFVQAPNGEFTVSPRNSPGEILLNLELGPDLNPYLAHLSRMYNGYAGGVEVQVLLAGNAFTAGKILFAAIPPNFPVDMISPAQITMLPHLIVDVRTLEPIMIPLPDVRNVFYHFNNQPQPRMRLVAMLYTPLRSNGSGDDVFTVSCRVLTRPTPDFEFIYLVPPSVESKTKPFTLPILTISELTNSRFPIPIEQLYTAPNENNVVQCQNGRCTLDGELQGTTQLLSSAVCSYRGRTVANSGDNWDQNLLQLSYPSGASYDPTDEVPAPLGTQDFSGILYGVLTQDNVSERTGEAKNAKGIYISTTSGKFTPKIGSIGLHSITENVHPNQQSRFTPVGVAQNENTPFQQWVLPHYAGALALNTNLAPAVAPTFPGEQLLFFRSRVPCVQGLQGQDAFIDCLLPQEWVNHFYQEAAPSQADVALIRYVNPDTGRTLFEAKLHRSGFITVSHTGAYPLVVPPNGHFRFDSWVNQFYSLAPMGTGNGR

SEQ ID NO: 2702 - protein, 538 aa, Artificial Sequence
  VP1__Norovirus_and/or_Norovirus-like__JX401280
MKMASSDANPSDGSSANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKIVFAAVPPNFPTEGLSPSQVTMFPHIIVDVRQLEPVLIPLPDVRNNFYHYNQANDSTLKLIAMLYTPLRANNAGDDVFTVSCRVLTRPSPDFDFIFLVPPTVESRTKPFTVPVLTVEEMTNSRFPIPLERLFTGPSTAFVVQPQNGRCTTDGVLLGTTQLSAVNICNFRGEVNHIAGTHDYTMRLTSQNWNNYDPTEEIPAPLGTPDFVGRIQGVLTQTTRSDGSTRSHKATVSTGSVHFTPKLGSVQFTTDTTNDLNAGQNTKFTPVGVEQTSGDHQSEPQQWTLPNYSGTPNHNVHLAPAVAPTFPGEQLLFFRSTLPGCGGYPNMNLDCLLPQEWVLHFYQEAAPAQSDVALLRFVNPDTGRVLFECKLHRSGFITVAHSGSHDLVIPPNGYFRFDSWVNQFYTLAPMGNGSGRRRV

SEQ ID NO: 2703 - protein, 538 aa, Artificial Sequence
  VP1__Norovirus_and/or_Norovirus-like__KC962462
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTESLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHIAGTHNYTMNLATQNWNSYDPTEEIPAPLGTPDFVGKIQGVLTQTTKTDGSTRGHKATVCIGSADFAPKLGRVQFETDTNNDLETNQNTKFTPVGVIQNGETAHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGSHDLVIPPNGYFRFDSWVNQFYTLAPMGNGTGRRR

SEQ ID NO: 2704 - protein, 538 aa, Artificial Sequence
  VP1__Norovirus_and/or_Norovirus-like__KX353974
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFEIHQNTRFTPVGVIQDGSTTHRNEPQQWVLPSYSGRSVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2705 - protein, 538 aa, Artificial Sequence
  VP1__Norovirus_and/or_Norovirus-like__KF060122
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRANGSTRGHKATVYTGSADFAPKLGRVQFATDTNNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2706 - protein, 538 aa, Artificial Sequence
  VP1__Norovirus_and/or_Norovirus-like__KR904234
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANSAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICSFRGDVTHIAGSRNYTMNLASQNWNSYDPTEEIPAPLGTPDFVGKIQGVLTQTTRTDGSTRGHRATVYTGSADFSPKLGRVQFATDTDNDFVANQNTKFTPVGVIQDGDTAHRNEPQQWVLPSYSGRNIHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2707 - protein, 538 aa, Artificial Sequence
  VP1__Norovirus_and/or_Norovirus-like__KR131769
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAIVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2708 - protein, 538 aa, Artificial Sequence
  VP1__Norovirus_and/or_Norovirus-like__KR131764
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIASSRNYTMNLASQNWNNYDPTEEIPAPLGTPDFVGKIQGMLTQTTKSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2709 - protein, 538 aa, Artificial Sequence
  VP1__Norovirus_and/or_Norovirus-like__GU390901
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2710 - protein, 538 aa, Artificial Sequence
  VP1__Norovirus_and/or_Norovirus-like__EU078408
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTRPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLSQTTRGDGSTRGHKATVSTGSVHFTPKLGSVQFTTDTNNDLETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2711 - protein, 538 aa, Artificial Sequence
  VP1__Norovirus_and/or_Norovirus-like__AB933676
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVSICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2712 - protein, 538 aa, Artificial Sequence
  VP1__Norovirus_and/or_Norovirus-like__KX354082
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKRDGSTRGHKATVYTGSADFTPKLGSVQFGTDTENDFETHQNTRFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2713 - protein, 538 aa, Artificial Sequence
  VP1__Norovirus_and/or_Norovirus-like__KJ407076
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGPHDLVIPPNGYFRFDSWVNQFYTLAPMGNGAGRRRV

SEQ ID NO: 2714 - protein, 538 aa, Artificial Sequence
  VP1__Norovirus_and/or_Norovirus-like__JX459636
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2715 - protein, 538 aa, Artificial Sequence
  VP1__Norovirus_and/or_Norovirus-like__JX445161
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2716 - protein, 538 aa, Artificial Sequence
  VP1__Norovirus_and/or_Norovirus-like__EU876888
MKMASSDASPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRGDGSTRGHKATVYTGSADFAPKLGRVQFATDTDNDFESNQNTKFTPVGVIQDGNTTHRNEPQQWVLPGYSGRDGHNVHLAPAVAPTYPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGAGRRR

SEQ ID NO: 2717 - protein, 538 aa, Artificial Sequence
  VP1__Norovirus_and/or_Norovirus-like__EU839584
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTKRDGSTRGHKATVSTGSVHFTPKLGSVQFSTDTSNDFEIGQNTRFTPVGVVQDGSTTHQNEPQQWVLPNYSGRDGHNVHLAPAVAPTFPGEQLLFFRSTMPGCSGYPNMNLDCLLPQEWVQHFYQESAPAQSDVALLRFVNPDTGRALFECKLHKSGYVTVAHTGQHDLVIPPNGYFRFDSWVNQFYTLAPMGNGAGRRR

SEQ ID NO: 2718 - protein, 538 aa, Artificial Sequence
  VP1__Norovirus_and/or_Norovirus-like__KX354090
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTRFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2719 - protein, 538 aa, Artificial Sequence
  VP1__Norovirus_and/or_Norovirus-like__KF060124
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRADGSTRGHKATVYTGSADFAPKLGRVQFATDTNNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2720 - protein, 538 aa, Artificial Sequence
  VP1__Norovirus_and/or_Norovirus-like__JX439826
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2721 - protein, 538 aa, Artificial Sequence
  VP1__Norovirus_and/or_Norovirus-like__JX439815
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2722 - protein, 538 aa, Artificial Sequence
  VP1__Norovirus_and/or_Norovirus-like__KC576912
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQMILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTDNDFETHQNTRFTPVGVIQDGATTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2723 - protein, 538 aa, Artificial Sequence
  VP1__Norovirus_and/or_Norovirus-like__GQ845368
MKMASSDASPSDGSAANLVPEVNNEVMALEPVVGAAIAAPVAGQQNIIDPWIRNNFVQAPGGEFTVSPRNAPGEILWSAPLGPDLNPYLSHLSRMYNGYAGGFEVQVILAGNAFTAGKVIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHITGSRNYTMNLASQNWNNYDPTEEIPAPLGTPDFVGKIQGMLTQTTRGDGSTRGHKATVYTGSADFAPKLGRVQFATDTDNDFESNQNTKFTPVGVIQDGNTTHQNEPQQWVLPGYSGRDGHNVHLAPAVAPTYPGEQLLFFRSTMPGCSGYPNMNLDCLLPQEWVQHFYQEAAPAQSEVALLRFVNPDTGRVLFECKLHKSGYVTVAHTGQHDLVIPPNGYFRFDSWVNQFYTLAPMGNGAGRRR

SEQ ID NO: 2724 - protein, 538 aa, Artificial Sequence
  VP1__Norovirus_and/or_Norovirus-like__AB541249
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2725 - protein, 538 aa, Artificial Sequence
  VP1__Norovirus_and/or_Norovirus-like__EU078412
MKMASNDASPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDLETGQNTRFTPVGVVQDGNSTHQNEPQQWVLPNYSGRAGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2726 - protein, 538 aa, Artificial Sequence
  VP1__Norovirus_and/or_Norovirus-like__AB445395
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNNHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2727 - protein, 538 aa, Artificial Sequence
  VP1__Norovirus_and/or_Norovirus-like__AB933655
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2728 - protein, 538 aa, Artificial Sequence
  VP1__Norovirus_and/or_Norovirus-like__KM245072
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2729 - protein, 538 aa, Artificial Sequence
  VP1__Norovirus_and/or_Norovirus-like__AB541282
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2730 - protein, 538 aa, Artificial Sequence
  VP1__Norovirus_and/or_Norovirus-like__AB541202
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNNHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2731 - protein, 538 aa, Artificial Sequence
  VP1__Norovirus_and/or_Norovirus-like__FJ514242
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2732 - protein, 538 aa, Artificial Sequence
  VP1__Norovirus_and/or_Norovirus-like__KX353976
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDIRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTDNDFETHQNTKFTPVGVIQDGSTTHRNEPQQWVLPSYSGRNVQNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2733 - protein, 538 aa, Artificial Sequence
  VP1__Norovirus_and/or_Norovirus-like__KX353952
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNVCTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTRFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2734 - protein, 538 aa, Artificial Sequence
  VP1__Norovirus_and/or_Norovirus-like__KR131771
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2735 - protein, 538 aa, Artificial Sequence
  VP1__Norovirus_and/or_Norovirus-like__AB933729
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKAIVYTGSADFAPKLGRVQFATDTDNDFGANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2736 - protein, 538 aa, Artificial Sequence
  VP1__Norovirus_and/or_Norovirus-like__AB933646
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGTGRRR

SEQ ID NO: 2737 - protein, 538 aa, Artificial Sequence
  VP1__Norovirus_and/or_Norovirus-like__JX155742
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2738 - protein, 538 aa, Artificial Sequence
  VP1__Norovirus_and/or_Norovirus-like__JN400614
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSASFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2739 - protein, 538 aa, Artificial Sequence
  VP1__Norovirus_and/or_Norovirus-like__JN400601
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGNGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYITVAHTGQHDLVIPPNGYFRFDSWVNQFYTLAPMGNGTGRRR

SEQ ID NO: 2740 - protein, 538 aa, Artificial Sequence
  VP1__Norovirus_and/or_Norovirus-like__JQ613538
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRIQFATDTNNDFDANQNTKFTPVGVIQDGGTTHRNEPQQWVLPSYSGRNTHNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2741 - protein, 538 aa, Artificial Sequence
  VP1__Norovirus_and/or_Norovirus-like__HM802543
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGDTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2742 - protein, 538 aa, Artificial Sequence
  VP1__Norovirus_and/or_Norovirus-like__AB541337
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2743 - protein, 538 aa, Artificial Sequence
  VP1__Norovirus_and/or_Norovirus-like__AB541252
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2744 - protein, 538 aa, Artificial Sequence
  VP1__Norovirus_and/or_Norovirus-like__GU270580
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFSPKLGRIQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRR

SEQ ID NO: 2745 - protein, 538 aa, Artificial Sequence
  VP1__Norovirus_and/or_Norovirus-like__EU876882
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2746 - protein, 538 aa, Artificial Sequence
  VP1__Norovirus_and/or_Norovirus-like__AB933649
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2747 - protein, 538 aa, Artificial Sequence
  VP1__Norovirus_and/or_Norovirus-like__JX439816
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2748 - protein, 538 aa, Artificial Sequence
  VP1__Norovirus_and/or_Norovirus-like__JX155739
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2749 - protein, 538 aa, Artificial Sequence
  VP1__Norovirus_and/or_Norovirus-like__HQ456338
MKMASNDASPSDGSAANLVPEVNNEVMALEPVVGAAIAAPVAGQKNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2750 - protein, 538 aa, Artificial Sequence
  VP1__Norovirus_and/or_Norovirus-like__AB541359
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSEVALLRFVNPDTGRVLFECKLHKSGYVTVAHTGQHDLVIPPNGYFRFDSWVNQFYTLAPMGNGTGRRR

SEQ ID NO: 2751 - protein, 538 aa, Artificial Sequence
  VP1__Norovirus_and/or_Norovirus-like__AB541280
MKMASNDANPSDGSAANLVPEVNNEVMALEPVVGAAIAAPVAGQTNVIDPWIRNNFVQAPGGEFTVSPRNAPGEILWSAALGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2752 - protein, 538 aa, Artificial Sequence
  VP1__Norovirus_and/or_Norovirus-like__AB541244
MKMASNDANPSDGSAANLVPEVNNEGMALEPVVGAAIAAPVAGQTNVIDPWIRNNFVQAPGGEFTVSPRNAPSEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGNGSTRGHKATVYTGSAPFTPKLGSVQFSTDTENDFETHQNTKFTPVGVIQDGSTTHRNEPQQWVLPSYSGRSVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2753 - protein, 538 aa, Artificial Sequence
  VP1__Norovirus_and/or_Norovirus-like__AB541203
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIVGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2754 - protein, 538 aa, Artificial Sequence
  VP1__Norovirus_and/or_Norovirus-like__GQ850882
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVFTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2755 - protein, 538 aa, Artificial Sequence
  VP1__Norovirus_and/or_Norovirus-like__KR131772
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2756 - protein, 538 aa, Artificial Sequence
  VP1__Norovirus_and/or_Norovirus-like__KR904215
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTTGSHNYTMNLATQNWSSYDPTEEIPAPLGTPDFVGKIQGVLTQTTKTDGSTRGHKATVYTGSADFAPKLGRVQFATDTDNDFEANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRR

SEQ ID NO: 2757 - protein, 538 aa, Artificial Sequence
  VP1__Norovirus_and/or_Norovirus-like__AB933715
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2758 - protein, 538 aa, Artificial Sequence
  VP1__Norovirus_and/or_Norovirus-like__AB933695
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2759 - protein, 538 aa, Artificial Sequence
  VP1__Norovirus_and/or_Norovirus-like__AB933681
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNAKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2760 - protein, 538 aa, Artificial Sequence
  VP1__Norovirus_and/or_Norovirus-like__AB933675
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIANSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2761 - protein, 538 aa, Artificial Sequence
  VP1__Norovirus_and/or_Norovirus-like__AB933652
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSTFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2762 - protein, 538 aa, Artificial Sequence
  VP1__Norovirus_and/or_Norovirus-like__KF429762
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2763 - protein, 538 aa, Artificial Sequence
  VP1__Norovirus_and/or_Norovirus-like__JX644027
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESKTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2764 - protein, 538 aa, Artificial Sequence
  VP1__Norovirus_and/or_Norovirus-like__JN400617
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2765 - protein, 538 aa, Artificial Sequence
  VP1__Norovirus_and/or_Norovirus-like__JQ613519
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGNTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2766 - protein, 538 aa, Artificial Sequence
  VP1__Norovirus_and/or_Norovirus-like__HQ456341
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVFLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2767 - protein, 538 aa, Artificial Sequence
  VP1__Norovirus_and/or_Norovirus-like__HM802540
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQLSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2768 - protein, 538 aa, Artificial Sequence
  VP1__Norovirus_and/or_Norovirus-like__AB541257
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2769 - protein, 538 aa, Artificial Sequence
  VP1__Norovirus_and/or_Norovirus-like__AB541242
MKMASNDASPSDGSAANLVPEVNNEVMALEPVVGAAIAAPVAGQQNVIDPWIRNNFVQAPGGEFTVSPRNAPGEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2770 - protein, 538 aa, Artificial Sequence
  VP1__Norovirus_and/or_Norovirus-like__AB541225
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTGDDFQTHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKAGYVTVAHTGQHDLVIPPNGYFRFDSWVNQFYTLAPMGNGTGRRR

SEQ ID NO: 2771 - protein, 538 aa, Artificial Sequence
  VP1__Norovirus_and/or_Norovirus-like__AB541190
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDMALLRFVNPDTGRVLFECKLHKSGYVTVAHTGQHDLVIPPNGYFRFDSWVNQFYTLAPMGNGTGRRR

SEQ ID NO: 2772 - protein, 538 aa, Artificial Sequence
  VP1__Norovirus_and/or_Norovirus-like__AB492092
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHISGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2773 - protein, 538 aa, Artificial Sequence
  VP1__Norovirus_and/or_Norovirus-like__EU916956
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTKFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2774 - protein, 538 aa, Artificial Sequence
  VP1__Norovirus_and/or_Norovirus-like__EF126962
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIRLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEVPAPLGTPDFVGKIQGVLTQTTRGDGSTRGHKATVSTGSVHFTPKLGSVQFSTDTSNDFETGQNTRFTPVGVVQDGSTTHQNEPQQWVLPDYSGRDNHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2775 - protein, 538 aa, Artificial Sequence
  VP1__Norovirus_and/or_Norovirus-like__AB663687
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQFLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2776 - protein, 538 aa, Artificial Sequence
  VP1__Norovirus_and/or_Norovirus-like__AB933759
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2777 - protein, 538 aa, Artificial Sequence
  VP1__Norovirus_and/or_Norovirus-like__AB933755
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2778 - protein, 538 aa, Artificial Sequence
  VP1__Norovirus_and/or_Norovirus-like__AB933677
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIASSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2779 - protein, 538 aa, Artificial Sequence
  VP1__Norovirus_and/or_Norovirus-like__AB933650
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2780 - protein, 538 aa, Artificial Sequence
  VP1__Norovirus_and/or_Norovirus-like__KM245071
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2781 - protein, 538 aa, Artificial Sequence
  VP1__Norovirus_and/or_Norovirus-like__KF712497
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWSNYDPTEEIPAPLGTPDFVGKIQGVLTQTTKGDGSTRGHKATVYTGSADFTPKLGSIQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2782 - protein, 538 aa, Artificial Sequence
  VP1__Norovirus_and/or_Norovirus-like__KC990829
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVLPSYSGRNVHNVHLAPAVAPNFPGEQLLFFRSTMPGCSGYPNTDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2783 - protein, 538 aa, Artificial Sequence
  VP1__Norovirus_and/or_Norovirus-like__JX439843
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLPPVNICTFRGDVTHIAGSRVYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRNAPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2784 - protein, 538 aa, Artificial Sequence
  VP1__Norovirus_and/or_Norovirus-like__JX439841
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2785 - protein, 538 aa, Artificial Sequence
  VP1__Norovirus_and/or_Norovirus-like__JX439830
MKMGSNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2786 - protein, 538 aa, Artificial Sequence
  VP1__Norovirus_and/or_Norovirus-like__JX439828
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2787 - protein, 538 aa, Artificial Sequence
  VP1__Norovirus_and/or_Norovirus-like__JX445153
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGAPDFVGKIQGVLTQTTRGDGSTRGHKATVSTGSVHFTPKLGSVQFSTDTSNDLETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2788 - protein, 538 aa, Artificial Sequence
  VP1__Norovirus_and/or_Norovirus-like__JX155754
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNAHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2789 - protein, 538 aa, Artificial Sequence
  VP1__Norovirus_and/or_Norovirus-like__JN400608
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2790 - protein, 538 aa, Artificial Sequence
  VP1__Norovirus_and/or_Norovirus-like__EF187497
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFSVPILTVEEMTNSRFPIPLEKLFTGPSSTIVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVNFTPKLGRIQFSTDTSNDFETGQSTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2791 - protein, 538 aa, Artificial Sequence
  VP1__Norovirus_and/or_Norovirus-like__AB668028
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2792 - protein, 538 aa, Artificial Sequence
  VP1__Norovirus_and/or_Norovirus-like__HM802542
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2793 - protein, 538 aa, Artificial Sequence
  VP1__Norovirus_and/or_Norovirus-like__HQ009513
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2794 - protein, 538 aa, Artificial Sequence
  VP1__Norovirus_and/or_Norovirus-like__AB541322
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2795 - protein, 538 aa, Artificial Sequence
  VP1__Norovirus_and/or_Norovirus-like__AB541321
MKMASNDANPSDGSTANLVPEVNNEVMALEPVVGAAIAAPVAGQQNVIDPWIRNNFVQAPGGEFTVSPQNAPSEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2796 - protein, 538 aa, Artificial Sequence
  VP1__Norovirus_and/or_Norovirus-like__AB541253
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2797 - protein, 538 aa, Artificial Sequence
  VP1__Norovirus_and/or_Norovirus-like__AB541250
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2798 - protein, 538 aa, Artificial Sequence
  VP1__Norovirus_and/or_Norovirus-like__AB541211
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2799 - protein, 538 aa, Artificial Sequence
  VP1__Norovirus_and/or_Norovirus-like__GQ246797
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2800 - protein, 538 aa, Artificial Sequence
  VP1__Norovirus_and/or_Norovirus-like__GQ246794
MKMASSDANPSDGSTANLVPEVNNEVMALEPVVGAAIAAPVAGQQNVIDPWIRNNFVQAPGGEFTVSPRNAPGEIPWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2801 - protein, 538 aa, Artificial Sequence
  VP1__Norovirus_and/or_Norovirus-like__EU876884
MKMASNDANPSDGSTANLVPEVNSEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPSYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2802 - protein, 538 aa, Artificial Sequence
  VP1__Norovirus_and/or_Norovirus-like__FJ411170
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDFETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2803 - protein, 538 aa, Artificial Sequence
  VP1__Norovirus_and/or_Norovirus-like__EU839589
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFRTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2804 - protein, 538 aa, Artificial Sequence
  VP1__Norovirus_and/or_Norovirus-like__KX353961
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGDTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2805 - protein, 538 aa, Artificial Sequence
  VP1__Norovirus_and/or_Norovirus-like__AB933757
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPTPLEKLFTGPSSTFVVQPQNGRCTTDGVLLGTTQLSPVNICTFRGDVTHITGSHNYTMNLASQNWNSYDPTEEIPAPLGTPDFVGKIQGVLTQTTRTDGSTRGHKATVYTGSAEFSPKLGRVQVATDTNNDFDANQNTKFTPVGVIQDGGTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2806 - protein, 538 aa, Artificial Sequence
  VP1__Norovirus_and/or_Norovirus-like__KM245074
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2807 - protein, 538 aa, Artificial Sequence
  VP1__Norovirus_and/or_Norovirus-like__EU921368
MKMASNDATPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTNIAGSQTYTMNLASQNWNNYDPTEEIPAPLGTPDFVGKIQGVLTQTTKGDGSTRGHKATVSTGSAQFTPKLGSVQFSTDTSTDFETGQNTRFTPVGVIQDGSTTHKNEPQQWVLPSYSGRDSHNVHLAPAVAPTFPGEQILFFRSTMPGCSGYPNMDLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2808 - protein, 538 aa, Artificial Sequence
  VP1__Norovirus_and/or_Norovirus-like__EU921338
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPAYSGRDNHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2809 - protein, 538 aa, Artificial Sequence
  VP1__Norovirus_and/or_Norovirus-like__LC005708
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2810 - protein, 538 aa, Artificial Sequence
  VP1__Norovirus_and/or_Norovirus-like__LC005704
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2811 - protein, 538 aa, Artificial Sequence
  VP1__Norovirus_and/or_Norovirus-like__KF429777
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWSNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2812 - protein, 538 aa, Artificial Sequence
  VP1__Norovirus_and/or_Norovirus-like__JX439840
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGIPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2813 - protein, 538 aa, Artificial Sequence
  VP1__Norovirus_and/or_Norovirus-like__JX644026
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2814 - protein, 538 aa, Artificial Sequence
  VP1__Norovirus_and/or_Norovirus-like__JX459906
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2815 - protein, 538 aa, Artificial Sequence
  VP1__Norovirus_and/or_Norovirus-like__JX459597
MKMASNDATPSDGSTANLVPEVNNEVMALEPVVGAAIAAPVAGQQNVIDPWIRNNFVQAPGGEFTVSPRNAPGEILCHAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATLSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2816 - protein, 538 aa, Artificial Sequence
  VP1__Norovirus_and/or_Norovirus-like__HQ456334
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFNTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2817 - protein, 538 aa, Artificial Sequence
  VP1__Norovirus_and/or_Norovirus-like__HM802553
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKIIFAAVPPTFPTEGLSPSQVTMFPHIIVDVRQLEPVLIPLPDVRNNFYHYNQSNDSTIKLVAMLYTPLRANNAGDDVFTVSCRVLTRPSPDFDFIFLVPPTVESRTKPFTVPILTVEEMTNSRFPIPLERLFTGPSSAFVVQPQNGRCTTDGVLLGTTQLSPVNICTFRGDVTNIPGSRTYRMNLASQNWNNYDPTEEIPAPLGTPDFVGKIQGVLTQTTKGDGSTRGHKATVRTGSADFTPKLGSVQFATDTDNDFVTGQNTRFTPVGVIHDGSSAHRNEPQQWVLPEYSGRSVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 2818 - protein, 538 aa, Artificial Sequence
  VP1__Norovirus_and/or_Norovirus-like__HQ008055
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWNSYDPTEEIPAPLGTPDFVGKIQGVLTQTTRADGSTRGHRATVYTGSAEFAPKLGRVQFATDTENDFDTNQNTKFTPVGVIQDGNTTHRNEPQQWVLPSYSGRNSHNVHLAPAVAPTFPGEQLLFFRSTMPGCSGYPNLDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2819 - protein, 538 aa, Artificial Sequence
  VP1__Norovirus_and/or_Norovirus-like__AB541360
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRR

SEQ ID NO: 2820 - protein, 538 aa, Artificial Sequence
  VP1__Norovirus_and/or_Norovirus-like__AB541262
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHVAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2821 - protein, 538 aa, Artificial Sequence
  VP1__Norovirus_and/or_Norovirus-like__AB541231
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFAVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2822 - protein, 538 aa, Artificial Sequence
  VP1__Norovirus_and/or_Norovirus-like__GQ246792
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFTPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2823 - protein, 538 aa, Artificial Sequence
  VP1__Norovirus_and/or_Norovirus-like__AB504329
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2824 - protein, 538 aa, Artificial Sequence
  VP1__Norovirus_and/or_Norovirus-like__AB504306
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMSKSRFPIPLEKLYTGPSSAFVVQPQNGRCTTDGVLLGTTQLSVVNICTFRGDVTHIAGSHDYTMNLASQNWNNYDPTEEIPAPLGTPDFVGKIQGMLTQTTREDGSTRAHKATVSTGSVHFTPKLGSVQYTTDTNNDFQTGQNTKFTPVGVIQDGNNHQNEPQQWVLPNYSGRTGHNVHLAPAVAPTFPGEQLLFFRSTMPGCSGYPNMNLDCLLPQEWVQHFYQEAAPAQSDVALLRFVNPDTGRFLFECKLHKSGYVTVAHTGPHDLVIPPNGYFRFDSWVNQFYTLAPMGNGAGRRRV

SEQ ID NO: 2825 - protein, 538 aa, Artificial Sequence
  VP1__Norovirus_and/or_Norovirus-like__GQ303445
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDHDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2826 - protein, 538 aa, Artificial Sequence
  VP1__Norovirus_and/or_Norovirus-like__EU839588
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILAVEEMTNSRFPIPLEKLFTGPSSALVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2827 - protein, 538 aa, Artificial Sequence
  VP1__Norovirus_and/or_Norovirus-like__DQ364459
MKMASNDASSSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDFETGQNTKFTPVGVVQDGNSTHQNEPQQWVLPNYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2828 - protein, 538 aa, Artificial Sequence
  VP1__Norovirus_and/or_Norovirus-like__KY628449
MKMASSDANPSDGSAANLVPEVNNEVMALEPVVGAAIAAPVAGQQNVIDPWIRNNFVQAPGGEFTVSPRNAPGEILWSAPLSPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSDFAVQPQNGRCTTDGVLLGTTQLSPVNICTFRGDVTHINGSSNYKMNLANQNWSNYDPTEEIPAPLGAPDFVGKIQGVLTQTTKEDGSTRGHKATVYTGSADFAPKLGRVQFETDTDHDLEIDQNTKFTPVGVIQNGGTTHRNEPKQWMLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHSGQHDLVVPPNGYFRFDSWVNQFYTLAPMGNGSGRRR

SEQ ID NO: 2829 - protein, 538 aa, Artificial Sequence
  VP1__Norovirus_and/or_Norovirus-like__KX371608
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQITKGDGSTRGHKATVYTGSADFTPKLGSVQFATDTENDFQTHQNTRFTPVGVIQDGGTTHQNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2830 - protein, 538 aa, Artificial Sequence
  VP1__Norovirus_and/or_Norovirus-like__KX354089
MKMASNDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2831 - protein, 538 aa, Artificial Sequence
  VP1__Norovirus_and/or_Norovirus-like__KX354001
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2832 - protein, 538 aa, Artificial Sequence
  VP1__Norovirus_and/or_Norovirus-like__KX353971
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2833 - protein, 538 aa, Artificial Sequence
  VP1__Norovirus_and/or_Norovirus-like__KR131766
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2834 - protein, 538 aa, Artificial Sequence
  VP1__Norovirus_and/or_Norovirus-like__AB663685
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRAKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2835 - protein, 538 aa, Artificial Sequence
  VP1__Norovirus_and/or_Norovirus-like__AB933746
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2836 - protein, 538 aa, Artificial Sequence
  VP1__Norovirus_and/or_Norovirus-like__AB933701
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2837 - protein, 538 aa, Artificial Sequence
  VP1__Norovirus_and/or_Norovirus-like__AB933686
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2838 - protein, 538 aa, Artificial Sequence
  VP1__Norovirus_and/or_Norovirus-like__AB933680
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2839 - protein, 538 aa, Artificial Sequence
  VP1__Norovirus_and/or_Norovirus-like__AB933672
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2840 - protein, 538 aa, Artificial Sequence
  VP1__Norovirus_and/or_Norovirus-like__AB933664
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFNTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2841 - protein, 538 aa, Artificial Sequence
  VP1__Norovirus_and/or_Norovirus-like__AB933662
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPIFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2842 - protein, 538 aa, Artificial Sequence
  VP1__Norovirus_and/or_Norovirus-like__AB933656
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2843 - protein, 538 aa, Artificial Sequence
  VP1__Norovirus_and/or_Norovirus-like__EU921340
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2844 - protein, 538 aa, Artificial Sequence
  VP1__Norovirus_and/or_Norovirus-like__KC962453
MKMASSDANPSDGSTANLVPEVNNEVMALEPVVGAAIAAPVAGQQNVIDPWIRNNFVQAPGGEFTISPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSIPVLTIEEMTNSRFPIPLEKLFTGPSSAFVVQPQNGRCSTDGVLLGTTQLSPVNICTFRGDVTHIAGSHNYTMNLASQNWNSYDPTEEIPAPLGTPDFVGKIQGVLTQTTRADGSTRGHKATVLTGSANFTPKLGRIQFATDTDNDFETNQNTKFTPVGVIQDGDTAHRNEPQQWVLPSYSGRNTHNVHLAPAVAPTFPGEQLLFFRSTIPGCSGYPNMDLDCLLPQEWVQFFYQEAAPAQSDVALLRFVNPDTGRVLFECKLHKSGYITVAHTGQHDLVIPPNGYFRFDSWVNQFYTLAPMGNGTGRRR

SEQ ID NO: 2845 - protein, 538 aa, Artificial Sequence
  VP1__Norovirus_and/or_Norovirus-like__KF712501
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFDTNQNTKFTPVGVIQDGGTTHRNEPQQWVLPSYSGRNTHNVHLAPAVAPTFPGEQLLFFRSTMPGSSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2846 - protein, 538 aa, Artificial Sequence
  VP1__Norovirus_and/or_Norovirus-like__JX459903
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDHDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2847 - protein, 538 aa, Artificial Sequence
  VP1__Norovirus_and/or_Norovirus-like__JX459629
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2848 - protein, 538 aa, Artificial Sequence
  VP1__Norovirus_and/or_Norovirus-like__JX445165
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSAEFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2849 - protein, 538 aa, Artificial Sequence
  VP1__Norovirus_and/or_Norovirus-like__HM635156
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2850 - protein, 538 aa, Artificial Sequence
  VP1__Norovirus_and/or_Norovirus-like__JQ622197
MKMASNDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2851 - protein, 538 aa, Artificial Sequence
  VP1__Norovirus_and/or_Norovirus-like__JQ613520
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRR

SEQ ID NO: 2852 - protein, 538 aa, Artificial Sequence
  VP1__Norovirus_and/or_Norovirus-like__HQ456320
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2853 - protein, 538 aa, Artificial Sequence
  VP1__Norovirus_and/or_Norovirus-like__AB541353
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2854 - protein, 538 aa, Artificial Sequence
  VP1__Norovirus_and/or_Norovirus-like__AB541348
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2855 - protein, 538 aa, Artificial Sequence
  VP1__Norovirus_and/or_Norovirus-like__AB541339
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGNTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2856 - protein, 538 aa, Artificial Sequence
  VP1__Norovirus_and/or_Norovirus-like__AB541303
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSAVFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2857 - protein, 538 aa, Artificial Sequence
  VP1__Norovirus_and/or_Norovirus-like__GQ246799
MKMASNDANPSDGSAANLVPEINNEVMALEPVVGAAIAAPVAGQQNVIDPWIRNNFVQAPGGEFTVSPRNAPGEILWSAPLGPDLNPYLSHLARMYNGYAGGFEVQVIPAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2858 - protein, 538 aa, Artificial Sequence
  VP1__Norovirus_and/or_Norovirus-like__EU876886
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSSVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2859 - protein, 538 aa, Artificial Sequence
  VP1__Norovirus_and/or_Norovirus-like__AB385630
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2860 - protein, 538 aa, Artificial Sequence
  VP1__Norovirus_and/or_Norovirus-like__KU182483
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2861 - protein, 538 aa, Artificial Sequence
  VP1__Norovirus_and/or_Norovirus-like__AB665364
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2862 - protein, 538 aa, Artificial Sequence
  VP1__Norovirus_and/or_Norovirus-like__AB663686
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLSWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2863 - protein, 538 aa, Artificial Sequence
  VP1__Norovirus_and/or_Norovirus-like__AB933702
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2864 - protein, 538 aa, Artificial Sequence
  VP1__Norovirus_and/or_Norovirus-like__AB933685
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFEIHQNTKFTPVGVIQDGSTTHRNEPQQWVLPSYSGRDAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2865 - protein, 538 aa, Artificial Sequence
  VP1__Norovirus_and/or_Norovirus-like__AB933645
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2866 - protein, 538 aa, Artificial Sequence
  VP1__Norovirus_and/or_Norovirus-like__LC005706
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2867 - protein, 538 aa, Artificial Sequence
  VP1__Norovirus_and/or_Norovirus-like__KM198562
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2868 - protein, 538 aa, Artificial Sequence
  VP1__Norovirus_and/or_Norovirus-like__KC409311
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLATQNWNSYDPTEEIPAPLGTPDFVGKIQGVLTQTTRADGSTRGHKATVYTGSADFAPKLGRVQFATDTNNDLGANQNTKFTPVGVIQDGGTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2869 - protein, 538 aa, Artificial Sequence
  VP1__Norovirus_and/or_Norovirus-like__KC409263
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2870 - protein, 538 aa, Artificial Sequence
  VP1__Norovirus_and/or_Norovirus-like__JX459900
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2871 - protein, 538 aa, Artificial Sequence
  VP1__Norovirus_and/or_Norovirus-like__JX459617
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2872 - protein, 538 aa, Artificial Sequence
  VP1__Norovirus_and/or_Norovirus-like__GQ845366
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPNYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPSNGYFRFDSWVNQFYTLAPMGNGTGRRR

SEQ ID NO: 2873 - protein, 538 aa, Artificial Sequence
  VP1__Norovirus_and/or_Norovirus-like__GQ845345
MKMASSDANPSDGSTANLVPEVNNEVMALEPVVGAAIAAPVAGQQNVIDPWIRNNFVQAPGGEFTVSPRNAPGEILWSAPLGPDMNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2874 - protein, 538 aa, Artificial Sequence
  VP1__Norovirus_and/or_Norovirus-like__GQ845341
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTEGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2875 - protein, 538 aa, Artificial Sequence
  VP1__Norovirus_and/or_Norovirus-like__HQ005292
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLATQNWNSYDPTEEIPAPLGTPDFVGKIQGVLTQTTRADGSTRGHKATVYTGSADFSPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2876 - protein, 538 aa, Artificial Sequence
  VP1__Norovirus_and/or_Norovirus-like__HQ456321
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTVNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2877 - protein, 538 aa, Artificial Sequence
  VP1__Norovirus_and/or_Norovirus-like__AB541326
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHITGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2878 - protein, 538 aa, Artificial Sequence
  VP1__Norovirus_and/or_Norovirus-like__AB541251
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLVSLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRR

SEQ ID NO: 2879 - protein, 538 aa, Artificial Sequence
  VP1__Norovirus_and/or_Norovirus-like__AB541241
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTIESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRGVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2880 - protein, 538 aa, Artificial Sequence
  VP1__Norovirus_and/or_Norovirus-like__AB541216
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2881 - protein, 538 aa, Artificial Sequence
  VP1__Norovirus_and/or_Norovirus-like__EU876885
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPANICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2882 - protein, 538 aa, Artificial Sequence
  VP1__Norovirus_and/or_Norovirus-like__AB447435
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2883 - protein, 538 aa, Artificial Sequence
  VP1__Norovirus_and/or_Norovirus-like__KX354073
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2884 - protein, 538 aa, Artificial Sequence
  VP1__Norovirus_and/or_Norovirus-like__KX353981
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2885 - protein, 538 aa, Artificial Sequence
  VP1__Norovirus_and/or_Norovirus-like__KU182479
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGAQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2886 - protein, 538 aa, Artificial Sequence
  VP1__Norovirus_and/or_Norovirus-like__KU182478
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWINQFYTLAPMGNGAGRRR

SEQ ID NO: 2887 - protein, 538 aa, Artificial Sequence
  VP1__Norovirus_and/or_Norovirus-like__AB972501
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFGTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 2888 - protein, 538 aa, Artificial Sequence
  VP1__Norovirus_and/or_Norovirus-like__KR904214
MKMASSDANPSVGSAANLVPEVNNEVMALEPVVGAAIAAPVAGQQNVIDPWIRNNFVQAPGGEFTVSPRNAPGEILWSAPLGPDLNPYLSHLARMYNGYAGGFEVLVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTTGSHNYTMNLATQNWNSYDPTEEIPAPLGTPDFVGKIQGVLTQTTKTDGSTRGHKATVYTGSADFAPKLGRVQFATDTDNDFEANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRR

SEQ ID NO: 2889 - protein, 538 aa, Artificial Sequence
  VP1__Norovirus_and/or_Norovirus-like__AB933758
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2890 - protein, 538 aa, Artificial Sequence
  VP1__Norovirus_and/or_Norovirus-like__AB933698
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFKGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHQNEPQQWVLPSYSGRDVPNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2891 - protein, 538 aa, Artificial Sequence
  VP1__Norovirus_and/or_Norovirus-like__KJ678141
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTNGSTRGHKATVYAGSANFAPKLGRVQFETDTDHDLEANQNTKFTPVGVIQDGNTTHRNEPQQWVLPSYSGRSTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2892 - protein, 538 aa, Artificial Sequence
  VP1__Norovirus_and/or_Norovirus-like__EU921347
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2893 - protein, 538 aa, Artificial Sequence
  VP1__Norovirus_and/or_Norovirus-like__JX459628
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2894 - protein, 538 aa, Artificial Sequence
  VP1__Norovirus_and/or_Norovirus-like__JQ613564
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHTAGSHNYTMNLASQNWNSYDPTEEIPAPLGTPDFVGKIQGVLTQTTRADGSTRGHKATVYTGSAEFSPKLGRVQFATDTDNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2895 - protein, 538 aa, Artificial Sequence
  VP1__Norovirus_and/or_Norovirus-like__GQ845332
MKMASNDANPSNGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2896 - protein, 538 aa, Artificial Sequence
  VP1__Norovirus_and/or_Norovirus-like__GQ856461
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFMGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2897 - protein, 538 aa, Artificial Sequence
  VP1__Norovirus_and/or_Norovirus-like__AB541245
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDITHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2898 - protein, 538 aa, Artificial Sequence
  VP1__Norovirus_and/or_Norovirus-like__AB541229
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2899 - protein, 538 aa, Artificial Sequence
  VP1__Norovirus_and/or_Norovirus-like__AB541226
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLTPMGNGTGRRR

SEQ ID NO: 2900 - protein, 538 aa, Artificial Sequence
  VP1__Norovirus_and/or_Norovirus-like__DQ078814
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEVLSPSQVTMFPHIIVDVRQLEPVLIPLPDVRNNLYHYNQSNDPTIRLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGRIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2901 - protein, 538 aa, Artificial Sequence
  VP1__Norovirus_and/or_Norovirus-like__EU078416
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2902 - protein, 538 aa, Artificial Sequence
  VP1__Norovirus_and/or_Norovirus-like__EU839590
MKMASNDANPSGGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2903 - protein, 538 aa, Artificial Sequence
  VP1__Norovirus_and/or_Norovirus-like__AB294783
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2904 - protein, 538 aa, Artificial Sequence
  VP1__Norovirus_and/or_Norovirus-like__AB303941
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2905 - protein, 538 aa, Artificial Sequence
  VP1__Norovirus_and/or_Norovirus-like__EF126961
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFEAGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAYTGQHDLVIPPNGYFRFDSWVNQFYTLAPMGNGAGRRR

SEQ ID NO: 2906 - protein, 538 aa, Artificial Sequence
  VP1__Norovirus_and/or_Norovirus-like__LC153749
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2907 - protein, 538 aa, Artificial Sequence
  VP1__Norovirus_and/or_Norovirus-like__KX371610
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFGTDTDHDFEANQSTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2908 - protein, 538 aa, Artificial Sequence
  VP1__Norovirus_and/or_Norovirus-like__KX354031
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2909 - protein, 538 aa, Artificial Sequence
  VP1__Norovirus_and/or_Norovirus-like__KX353990
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2910 - protein, 538 aa, Artificial Sequence
  VP1__Norovirus_and/or_Norovirus-like__KX353972
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2911 - protein, 538 aa, Artificial Sequence
  VP1__Norovirus_and/or_Norovirus-like__KX353968
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNIHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2912 - protein, 538 aa, Artificial Sequence
  VP1__Norovirus_and/or_Norovirus-like__KX353967
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNIHNVHLAPAVAPNFPGEQLLFFRSTMPGCSGYPNVDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2913 - protein, 538 aa, Artificial Sequence
  VP1__Norovirus_and/or_Norovirus-like__KX353966
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQITMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLERLFTGPSSAFVVQPQNGRCTTDGVLLGTTQLSPVNICTFRGDVNHIAGSRNYTMNLASLNWNNYDPTEETPAPLGTPDFVGKIQGVLTQTTRGNGSTRGHRATVYTGSADFTPKLGRIQFATDTDNDFETHQNTKFTPVGVIQDGNTTHRNEPQQWVLPSYSGRNVQNVHLAPAVAPNFPGEQLLFFRSTMPGCSGYPNMDLDCLLPQEWVQHFYQEAAPAQSDVALLRFVNPDTGRVLFECKLHKSGFVTVAHTGQHDLVIPPNGYFRFDSWVNQFYTLAPMGKGTGRRR

SEQ ID NO: 2914 - protein, 538 aa, Artificial Sequence
  VP1__Norovirus_and/or_Norovirus-like__AB663684
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2915 - protein, 538 aa, Artificial Sequence
  VP1__Norovirus_and/or_Norovirus-like__KR904209
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRADGSTRGHKATVYTGSADFSPKLGRVQFATDTNNDFDANQNTKFTPVGVIQDGETAHRNEPQQWVLPSYSGRNIHNVHLAPAVAPTFPGEQLLFFRSTMPGCSGYPNMELDCLIPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2916 - protein, 538 aa, Artificial Sequence
  VP1__Norovirus_and/or_Norovirus-like__AB933716
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2917 - protein, 538 aa, Artificial Sequence
  VP1__Norovirus_and/or_Norovirus-like__AB933666
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQDTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2918 - protein, 538 aa, Artificial Sequence
  VP1__Norovirus_and/or_Norovirus-like__EU921349
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2919 - protein, 538 aa, Artificial Sequence
  VP1__Norovirus_and/or_Norovirus-like__EU921348
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVNFTPKLGRIQFSTDTSNDFETGQNTRFTPVGVVQDGSTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2920 - protein, 538 aa, Artificial Sequence
  VP1__Norovirus_and/or_Norovirus-like__EU921345
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPDYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2921 - protein, 538 aa, Artificial Sequence
  VP1__Norovirus_and/or_Norovirus-like__KP698924
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGIPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2922 - protein, 538 aa, Artificial Sequence
  VP1__Norovirus_and/or_Norovirus-like__LC005707
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDQGRVLFECKLHKSGYVTVAHTGQHDLVIPPNGYFRFDSWVNQFYTLAPMGNGTGRRR

SEQ ID NO: 2923 - protein, 538 aa, Artificial Sequence
  VP1__Norovirus_and/or_Norovirus-like__KJ541743
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2924 - protein, 538 aa, Artificial Sequence
  VP1__Norovirus_and/or_Norovirus-like__KF177443
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2925 - protein, 538 aa, Artificial Sequence
  VP1__Norovirus_and/or_Norovirus-like__JX439842
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRVYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRNAPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2926 - protein, 538 aa, Artificial Sequence
  VP1__Norovirus_and/or_Norovirus-like__HF952135
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLAAQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2927 - protein, 538 aa, Artificial Sequence
  VP1__Norovirus_and/or_Norovirus-like__JX459598
MKMASNDATPSDGSTANLVPEVNNEVMALEPVVGAAIAAPVAGQQNVIDPWIRNNFVQAPGGEFTVSPRNAPGEILWHAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2928 - protein, 538 aa, Artificial Sequence
  VP1__Norovirus_and/or_Norovirus-like__JX445162
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLIIPPNGYFRFDSWVNQFYTLAPMGNGTGRRR

SEQ ID NO: 2929 - protein, 538 aa, Artificial Sequence
  VP1__Norovirus_and/or_Norovirus-like__JX445154
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKPGYVTVAHTGQHDLVIPPNGYFRFDSWVNQFYTLAPMGNGAGRRR

SEQ ID NO: 2930 - protein, 538 aa, Artificial Sequence
  VP1__Norovirus_and/or_Norovirus-like__JX155752
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYAMNLASLNWNNYDPTEEIPAPLGTPDFVGKIQGVLTQTTKGDGSTRGHKATIYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYLTVAHTGQHDLVIPPNGYFRFDSWVNQFYTLAPMGNGTGRRR

SEQ ID NO: 2931 - protein, 538 aa, Artificial Sequence
  VP1__Norovirus_and/or_Norovirus-like__HM748971
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWALPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2932 - protein, 538 aa, Artificial Sequence
  VP1__Norovirus_and/or_Norovirus-like__GQ845367
MKMASSDANPSDGSTANLVPEVNNEVMALEPVVGAAIAAPVAGQQNVIDPWIRNNFVQAPGGEFTVSPRNAPGEILWSAPLGPDMNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2933 - protein, 538 aa, Artificial Sequence
  VP1__Norovirus_and/or_Norovirus-like__GQ856455
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQPNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTHGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2934 - protein, 538 aa, Artificial Sequence
  VP1__Norovirus_and/or_Norovirus-like__GQ856447
MKMASNDANPSDGSAANLVPEVNNEVMALEPVVGAAIAAPVAGQQNVIDPWIRNNFVQAPGGEFTVSPRNAPGEILWSAPLGPDLNPNLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2935 - protein, 538 aa, Artificial Sequence
  VP1__Norovirus_and/or_Norovirus-like__AB541318
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2936 - protein, 538 aa, Artificial Sequence
  VP1__Norovirus_and/or_Norovirus-like__AB541307
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPSNGYFRFDSWVNQFYTLAPMGNGTGRRR

SEQ ID NO: 2937 - protein, 538 aa, Artificial Sequence
  VP1__Norovirus_and/or_Norovirus-like__AB541254
MKMASNDANPSDGSAANLVPEVNNEVMALEPVVGAAIAAPVAGQQNVIDPWIRNNFVKAPGGEFTVSPRNSPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSADFTPKLGSVQFGTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2938 - protein, 538 aa, Artificial Sequence
  VP1__Norovirus_and/or_Norovirus-like__AB541243
MKMASNDANPSDGSAANLVPEVNNEVMALEPVVGAAIAAPVAGQQNVIDPWIRNNFVQAPGGEFTVSPRNAPGEIPWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2939 - protein, 538 aa, Artificial Sequence
  VP1__Norovirus_and/or_Norovirus-like__AB541232
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2940 - protein, 538 aa, Artificial Sequence
  VP1__Norovirus_and/or_Norovirus-like__GQ246800
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFPVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2941 - protein, 538 aa, Artificial Sequence
  VP1__Norovirus_and/or_Norovirus-like__GU390900
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2942 - protein, 538 aa, Artificial Sequence
  VP1__Norovirus_and/or_Norovirus-like__AB504328
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLTSLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGINVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2943 - protein, 538 aa, Artificial Sequence
  VP1__Norovirus_and/or_Norovirus-like__AB447434
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2944 - protein, 538 aa, Artificial Sequence
  VP1__Norovirus_and/or_Norovirus-like__EU839591
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIRGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2945 - protein, 538 aa, Artificial Sequence
  VP1__Norovirus_and/or_Norovirus-like__AB291542
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2946 - protein, 538 aa, Artificial Sequence
  VP1__Norovirus_and/or_Norovirus-like__KX354123
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATLYTGSAEFAPKLGRVQFETDTNHDFEANQNTKFTPVGVIQDGSTTHRNEPQQWVLPTYSGRNTHNVHLAPAVAPTFPGEQLLFFRSTMPGCSGYPNMDLDCLLPQEWVQHFYQEAAPAQSDVALLRFVNPDTGRVLFECKLHKSGYITVAHTGQHDLVIPPNGYFRFDSWVNQFYTLAPMGNGTGRRR

SEQ ID NO: 2947 - protein, 538 aa, Artificial Sequence
  VP1__Norovirus_and/or_Norovirus-like__KX354050
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGLEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRADGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2948 - protein, 538 aa, Artificial Sequence
  VP1__Norovirus_and/or_Norovirus-like__AB933717
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2949 - protein, 538 aa, Artificial Sequence
  VP1__Norovirus_and/or_Norovirus-like__AB933707
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2950 - protein, 538 aa, Artificial Sequence
  VP1__Norovirus_and/or_Norovirus-like__AB933705
MKMASNDANPSDGSAANLVPEVNNEVMALEPVVGAAIAAPVAGQQNVIDPWIRNNFVQAPGGEFTVSPRNAPGETLWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2951 - protein, 538 aa, Artificial Sequence
  VP1__Norovirus_and/or_Norovirus-like__AB933704
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRR

SEQ ID NO: 2952 - protein, 538 aa, Artificial Sequence
  VP1__Norovirus_and/or_Norovirus-like__AB933699
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2953 - protein, 538 aa, Artificial Sequence
  VP1__Norovirus_and/or_Norovirus-like__AB933679
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2954 - protein, 538 aa, Artificial Sequence
  VP1__Norovirus_and/or_Norovirus-like__AB933661
MKMASNDANPSDGSAANLVPEVNNEVMALEPVVGAAIAAPVAGQQNVIDPWIRNNFVQAPGGEFTVSPRNAPGEILWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2955 - protein, 538 aa, Artificial Sequence
  VP1__Norovirus_and/or_Norovirus-like__KT152148
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2956 - protein, 538 aa, Artificial Sequence
  VP1__Norovirus_and/or_Norovirus-like__EU921393
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGSNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2957 - protein, 538 aa, Artificial Sequence
  VP1__Norovirus_and/or_Norovirus-like__KM396961
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRTDGSTRGHKATVRTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2958 - protein, 538 aa, Artificial Sequence
  VP1__Norovirus_and/or_Norovirus-like__KM198485
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2959 - protein, 538 aa, Artificial Sequence
  VP1__Norovirus_and/or_Norovirus-like__KF306214
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGVLTQTTRTDGSTRGHKATVYTGSADFAPKLGRVQFETDTDHDFEVNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHNGQHDLVIPPNGYFRFDSWVNQFYTLAPMGNGTGRRR

SEQ ID NO: 2960 - protein, 538 aa, Artificial Sequence
  VP1__Norovirus_and/or_Norovirus-like__JX439831
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQFLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2961 - protein, 538 aa, Artificial Sequence
  VP1__Norovirus_and/or_Norovirus-like__KC409281
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2962 - protein, 538 aa, Artificial Sequence
  VP1__Norovirus_and/or_Norovirus-like__JX459639
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2963 - protein, 538 aa, Artificial Sequence
  VP1__Norovirus_and/or_Norovirus-like__JX459609
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFAVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYATVAHTGQHDLVIPPNGYFRFDSWVNQFYTLAPMGNGTGRRR

SEQ ID NO: 2964 - protein, 538 aa, Artificial Sequence
  VP1__Norovirus_and/or_Norovirus-like__JN400599
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTSRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKPGYVTVAHTGQHDLVIPPNGYFRFDSWVNQFYTLAPMGNGAGRRR

SEQ ID NO: 2965 - protein, 538 aa, Artificial Sequence
  VP1__Norovirus_and/or_Norovirus-like__JQ613539
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2966 - protein, 538 aa, Artificial Sequence
  VP1__Norovirus_and/or_Norovirus-like__HQ456329
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIYLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2967 - protein, 538 aa, Artificial Sequence
  VP1__Norovirus_and/or_Norovirus-like__HM802536
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGAPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2968 - protein, 538 aa, Artificial Sequence
  VP1__Norovirus_and/or_Norovirus-like__HM802532
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2969 - protein, 538 aa, Artificial Sequence
  VP1__Norovirus_and/or_Norovirus-like__AB541341
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2970 - protein, 538 aa, Artificial Sequence
  VP1__Norovirus_and/or_Norovirus-like__AB541264
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTRGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2971 - protein, 538 aa, Artificial Sequence
  VP1__Norovirus_and/or_Norovirus-like__AB541236
MKMASNDANPSDGSAANLVQEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYIMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2972 - protein, 538 aa, Artificial Sequence
  VP1__Norovirus_and/or_Norovirus-like__AB541208
MKMASNDPSPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2973 - protein, 538 aa, Artificial Sequence
  VP1__Norovirus_and/or_Norovirus-like__EU876890
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPNFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2974 - protein, 538 aa, Artificial Sequence
  VP1__Norovirus_and/or_Norovirus-like__AB385638
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIANTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGGDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2975 - protein, 538 aa, Artificial Sequence
  VP1__Norovirus_and/or_Norovirus-like__AB385635
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTDSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDLETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 2976 - protein, 538 aa, Artificial Sequence
  VP1__Norovirus_and/or_Norovirus-like__EU366113
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQSSTDTENDFETHQNTKFTPVGVIQDGSTTHRNEPQQWVLPSYSGRNVHNVHLAPAVAPTFPGEQLLFFRSTVPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2977 - protein, 538 aa, Artificial Sequence
  VP1__Norovirus_and/or_Norovirus-like__KX354097
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTKTDGSTRGHKATVYTGSADFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2978 - protein, 538 aa, Artificial Sequence
  VP1__Norovirus_and/or_Norovirus-like__AB933727
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2979 - protein, 538 aa, Artificial Sequence
  VP1__Norovirus_and/or_Norovirus-like__AB933726
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2980 - protein, 538 aa, Artificial Sequence
  VP1__Norovirus_and/or_Norovirus-like__AB933720
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKVQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2981 - protein, 538 aa, Artificial Sequence
  VP1__Norovirus_and/or_Norovirus-like__AB933691
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2982 - protein, 538 aa, Artificial Sequence
  VP1__Norovirus_and/or_Norovirus-like__AB933682
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2983 - protein, 538 aa, Artificial Sequence
  VP1__Norovirus_and/or_Norovirus-like__KM245069
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIASTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2984 - protein, 538 aa, Artificial Sequence
  VP1__Norovirus_and/or_Norovirus-like__LC005717
MKMASNDANPSDGSAANLVPEVNNEVMALEPVVGAAIAAPVAGQQNVIDPWIKNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2985 - protein, 538 aa, Artificial Sequence
  VP1__Norovirus_and/or_Norovirus-like__LC005705
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATIYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2986 - protein, 538 aa, Artificial Sequence
  VP1__Norovirus_and/or_Norovirus-like__KC894943
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPNYSGSDVPNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2987 - protein, 538 aa, Artificial Sequence
  VP1__Norovirus_and/or_Norovirus-like__KF060023
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2988 - protein, 538 aa, Artificial Sequence
  VP1__Norovirus_and/or_Norovirus-like__KC409310
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2989 - protein, 538 aa, Artificial Sequence
  VP1__Norovirus_and/or_Norovirus-like__JX989073
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDIPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2990 - protein, 538 aa, Artificial Sequence
  VP1__Norovirus_and/or_Norovirus-like__JX459902
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPSFPIEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGNVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2991 - protein, 538 aa, Artificial Sequence
  VP1__Norovirus_and/or_Norovirus-like__JX459644
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMNLDCLIPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 2992 - protein, 538 aa, Artificial Sequence
  VP1__Norovirus_and/or_Norovirus-like__JX459610
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWTNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2993 - protein, 538 aa, Artificial Sequence
  VP1__Norovirus_and/or_Norovirus-like__JX459606
MKMASNDANPSDGSAANLVPEVNNEVMALEPVVGAAIAAPVAGQQNVIDPWIRNNFVQAPGGEFTVSPRNAPGEILWRAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2994 - protein, 538 aa, Artificial Sequence
  VP1__Norovirus_and/or_Norovirus-like__JX445159
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTEGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2995 - protein, 538 aa, Artificial Sequence
  VP1__Norovirus_and/or_Norovirus-like__JN400606
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2996 - protein, 538 aa, Artificial Sequence
  VP1__Norovirus_and/or_Norovirus-like__JQ613562
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKSFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFGTDTDNDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRKR

SEQ ID NO: 2997 - protein, 538 aa, Artificial Sequence
  VP1__Norovirus_and/or_Norovirus-like__HQ456343
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTKFTPVGVIQDGSTTHRNEPQQWVPPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 2998 - protein, 538 aa, Artificial Sequence
  VP1__Norovirus_and/or_Norovirus-like__HQ456342
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGGTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 2999 - protein, 538 aa, Artificial Sequence
  VP1__Norovirus_and/or_Norovirus-like__HQ456340
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSSSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKADGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3000 - protein, 538 aa, Artificial Sequence
  VP1__Norovirus_and/or_Norovirus-like__HQ456326
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3001 - protein, 538 aa, Artificial Sequence
  VP1__Norovirus_and/or_Norovirus-like__HM802527
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHISGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVTQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3002 - protein, 538 aa, Artificial Sequence
  VP1__Norovirus_and/or_Norovirus-like__GQ856448
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3003 - protein, 538 aa, Artificial Sequence
  VP1__Norovirus_and/or_Norovirus-like__AB541347
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSVPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3004 - protein, 538 aa, Artificial Sequence
  VP1__Norovirus_and/or_Norovirus-like__AB541298
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLTPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDLALLRFVNPDTGRVLFECKLHKSGYVTVAHTGQHDLVIPPNGYFRFDSWVNQFYTLAPMGNGTGRRR

SEQ ID NO: 3005 - protein, 538 aa, Artificial Sequence
  VP1__Norovirus_and/or_Norovirus-like__AB541270
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRR

SEQ ID NO: 3006 - protein, 538 aa, Artificial Sequence
  VP1__Norovirus_and/or_Norovirus-like__AB541263
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNVCTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3007 - protein, 538 aa, Artificial Sequence
  VP1__Norovirus_and/or_Norovirus-like__AB541256
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLIPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 3008 - protein, 538 aa, Artificial Sequence
  VP1__Norovirus_and/or_Norovirus-like__AB541240
MKMASNDANPSDGSAANLVPEVNNEVMALEPVVGAAIAAPVAGQQNVIDPWIRNNFVQAPGGEFTVSPRNAPSEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASINWNNYDPTEEIPAPLGTPDFVGKIQGVLTQTTKGDGSTRGHKATVYTGSAPFTPKLGSVQFSTDTENDFETHQNTKFTPVGVIQDGGTTHQNEPQQWVLPGYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3009 - protein, 538 aa, Artificial Sequence
  VP1__Norovirus_and/or_Norovirus-like__AB541233
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKAGYVTVAHTGQHDLVIPPNGYFRFDSWVNQFYTLAPMGNGTGRRR

SEQ ID NO: 3010 - protein, 538 aa, Artificial Sequence
  VP1__Norovirus_and/or_Norovirus-like__AB541215
MKMASNDANPSDGSAANLVPEVNNEVMALEPVVGAAIAAPVAGQQNVIDPWIRNNFVQAPGGEFTVSPRNAPGEIPWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3011 - protein, 538 aa, Artificial Sequence
  VP1__Norovirus_and/or_Norovirus-like__AB541201
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3012 - protein, 538 aa, Artificial Sequence
  VP1__Norovirus_and/or_Norovirus-like__FJ411172
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTRRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKSGYVTVAHTGQHDLVIPPNGYFRFDSWVNQFYTLAPMGNGAGRRR

SEQ ID NO: 3013 - protein, 538 aa, Artificial Sequence
  VP1__Norovirus_and/or_Norovirus-like__AB447449
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNHFYTLAPMGNGTGRRR

SEQ ID NO: 3014 - protein, 538 aa, Artificial Sequence
  VP1__Norovirus_and/or_Norovirus-like__AB447431
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRR

SEQ ID NO: 3015 - protein, 538 aa, Artificial Sequence
  VP1__Norovirus_and/or_Norovirus-like__EU078415
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPDYSGRNSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3016 - protein, 538 aa, Artificial Sequence
  VP1__Norovirus_and/or_Norovirus-like__AB385643
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRGDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3017 - protein, 538 aa, Artificial Sequence
  VP1__Norovirus_and/or_Norovirus-like__AB385636
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTDSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRGDGSTRGHKATVSTGSVHFTPKLGSVQFSTDTSNDLETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3018 - protein, 538 aa, Artificial Sequence
  VP1__Norovirus_and/or_Norovirus-like__AB385629
MKMASNDATPSDGSTANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIANTQNYTMNLASQNWNNYDPTEEIPAPLGTPDFVGRIQGVLTQTTRGDGSTRGHKATVSTGSVHFTPKLGSVQFSTDTSNDLETGQNTRFTPVGVVQDGGTTHRNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3019 - protein, 538 aa, Artificial Sequence
  VP1__Norovirus_and/or_Norovirus-like__EU839586
MKMASNDASPSDGSTANLVPEVNNEVMALEPVVGAAIAAPVTGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTAHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3020 - protein, 538 aa, Artificial Sequence
  VP1__Norovirus_and/or_Norovirus-like__EU310927
MKMASSDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHDYTMNLASQNWNNYDPTEEIPAPLGTPDFVGKIQGVLTQTTRGDGSTRGHKATVSTGSVHFTPKLGSVQFTTDTNNDLETGQNTKFTPVGVVQDGNSAHQNEPQQWVLPNYSGRTGHNVHLAPAVAPTFPGEQLLFFRSTMPGCSGYPNMNLDCLLPQEWVLHFYQEAAPAQSDVALLRFVNPDTGRVLFECKLHKSGYVTVAHTGPHDLVIPPNGYFRFDSWVNQFYTLAPMGNGAGRRR

SEQ ID NO: 3021 - protein, 538 aa, Artificial Sequence
  VP1__Norovirus_and/or_Norovirus-like__AB294787
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3022 - protein, 538 aa, Artificial Sequence
  VP1__Norovirus_and/or_Norovirus-like__AY587987
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3023 - protein, 538 aa, Artificial Sequence
  VP1__Norovirus_and/or_Norovirus-like__AY502019
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3024 - protein, 538 aa, Artificial Sequence
  VP1__Norovirus_and/or_Norovirus-like__LC177653
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3025 - protein, 538 aa, Artificial Sequence
  VP1__Norovirus_and/or_Norovirus-like__AB972486
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFATDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3026 - protein, 538 aa, Artificial Sequence
  VP1__Norovirus_and/or_Norovirus-like__KR904235
MKMASSDANPSDGSTANLVPEVNNEVMALEPVVGAAIAAPVAGQQNVIDPWIRNNFVQAPGGEFTVSPRNAPGEILWSTPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3027 - protein, 538 aa, Artificial Sequence
  VP1__Norovirus_and/or_Norovirus-like__AB933753
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3028 - protein, 538 aa, Artificial Sequence
  VP1__Norovirus_and/or_Norovirus-like__AB933721
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPVLTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3029 - protein, 538 aa, Artificial Sequence
  VP1__Norovirus_and/or_Norovirus-like__AB933706
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGLLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3030 - protein, 538 aa, Artificial Sequence
  VP1__Norovirus_and/or_Norovirus-like__AB933669
MKMASNDATASDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPIEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3031 - protein, 538 aa, Artificial Sequence
  VP1__Norovirus_and/or_Norovirus-like__EU921350
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWALPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3032 - protein, 538 aa, Artificial Sequence
  VP1__Norovirus_and/or_Norovirus-like__LC005712
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATIYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3033 - protein, 538 aa, Artificial Sequence
  VP1__Norovirus_and/or_Norovirus-like__LC018707
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSANFSPKLGRVQFETDTDHDFEVNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3034 - protein, 538 aa, Artificial Sequence
  VP1__Norovirus_and/or_Norovirus-like__KM982955
MKMASSDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3035 - protein, 538 aa, Artificial Sequence
  VP1__Norovirus_and/or_Norovirus-like__KM982949
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWSNYDPTEEIPAPLGTPDFVGKIQGVLTQTTRTDGSTRGHKATVYTGSADFAPKLGRVQFGTDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3036 - protein, 538 aa, Artificial Sequence
  VP1__Norovirus_and/or_Norovirus-like__KM406485
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3037 - protein, 538 aa, Artificial Sequence
  VP1__Norovirus_and/or_Norovirus-like__KM198574
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3038 - protein, 538 aa, Artificial Sequence
  VP1__Norovirus_and/or_Norovirus-like__KM198517
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQINDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDIHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3039 - protein, 538 aa, Artificial Sequence
  VP1__Norovirus_and/or_Norovirus-like__JX439839
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3040 - protein, 538 aa, Artificial Sequence
  VP1__Norovirus_and/or_Norovirus-like__JX439837
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3041 - protein, 538 aa, Artificial Sequence
  VP1__Norovirus_and/or_Norovirus-like__KC631815
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3042 - protein, 538 aa, Artificial Sequence
  VP1__Norovirus_and/or_Norovirus-like__KC409315
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTEDDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3043 - protein, 538 aa, Artificial Sequence
  VP1__Norovirus_and/or_Norovirus-like__KC409289
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEVPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3044 - protein, 538 aa, Artificial Sequence
  VP1__Norovirus_and/or_Norovirus-like__KC409278
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3045 - protein, 538 aa, Artificial Sequence
  VP1__Norovirus_and/or_Norovirus-like__KC175402
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3046 - protein, 538 aa, Artificial Sequence
  VP1__Norovirus_and/or_Norovirus-like__JX459616
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3047 - protein, 538 aa, Artificial Sequence
  VP1__Norovirus_and/or_Norovirus-like__JX459599
MKMASNDATPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTNIAGSQTYTMNLASQNWNNYDPTEEIPAPLGTPDFVGRIQGVLTQTTRGDGSTRGHKATVSTGSAYFTPKLGSVQFSTDTSTDFETGQNTRFTPVGVVQDGSTTHKNEPQQWVLPSYSGRDSHNVHLAPAVAPTFPGEQILFFRSTMPGCSGYPNMDLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3048 - protein, 538 aa, Artificial Sequence
  VP1__Norovirus_and/or_Norovirus-like__JN400603
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQITKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3049 - protein, 538 aa, Artificial Sequence
  VP1__Norovirus_and/or_Norovirus-like__JQ613572
MKMASNDANPSDGSAANLVPEVNNEVMALEPVVGAAIAAPVAGQQNVIDPWIRNNFVQAPGGEFTVSPRNAPGETLWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTQGDGSTRGHKATVYTGSADFTPKLGSVQFATDTENDFETHQNTKFTPVGVIQDGSTTHRNEPQQWALPSYSGRSAHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3050 - protein, 538 aa, Artificial Sequence
  VP1__Norovirus_and/or_Norovirus-like__JQ613525
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGAGRRR

SEQ ID NO: 3051 - protein, 538 aa, Artificial Sequence
  VP1__Norovirus_and/or_Norovirus-like__JQ613510
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYAMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3052 - protein, 538 aa, Artificial Sequence
  VP1__Norovirus_and/or_Norovirus-like__GQ856450
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNASTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3053 - protein, 538 aa, Artificial Sequence
  VP1__Norovirus_and/or_Norovirus-like__AB541296
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVIHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3054 - protein, 538 aa, Artificial Sequence
  VP1__Norovirus_and/or_Norovirus-like__AB541212
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 3055 - protein, 538 aa, Artificial Sequence
  VP1__Norovirus_and/or_Norovirus-like__AB504321
MKMASNDANPSDGSAANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3056 - protein, 538 aa, Artificial Sequence
  VP1__Norovirus_and/or_Norovirus-like__AB294785
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3057 - protein, 538 aa, Artificial Sequence
  VP1__Norovirus_and/or_Norovirus-like__AB294780
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTKGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3058 - protein, 538 aa, Artificial Sequence
  VP1__Norovirus_and/or_Norovirus-like__AB303933
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYLTVAHTGQHDLVIPPNGYFRFDSWVNQFYTLAPMGNGTGRRR

SEQ ID NO: 3059 - protein, 538 aa, Artificial Sequence
  VP1__Norovirus_and/or_Norovirus-like__AY587988
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKTGYVTVAHTGQHDLVIPPNGYFRFDSWVNQFYTLAPMGNGTGRRR

SEQ ID NO: 3060 - protein, 538 aa, Artificial Sequence
  VP1__Norovirus_and/or_Norovirus-like__KX354103
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSAEFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3061 - protein, 538 aa, Artificial Sequence
  VP1__Norovirus_and/or_Norovirus-like__KX354048
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNTDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3062 - protein, 538 aa, Artificial Sequence
  VP1__Norovirus_and/or_Norovirus-like__KX354047
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3063 - protein, 538 aa, Artificial Sequence
  VP1__Norovirus_and/or_Norovirus-like__KU985161
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFATDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3064 - protein, 538 aa, Artificial Sequence
  VP1__Norovirus_and/or_Norovirus-like__AB972517
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3065 - protein, 538 aa, Artificial Sequence
  VP1__Norovirus_and/or_Norovirus-like__AB972494
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3066 - protein, 538 aa, Artificial Sequence
  VP1__Norovirus_and/or_Norovirus-like__KU311163
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFTVPILTVEEMTNSRFPIPLEKLFTGPSNAFVVQPQNGRCTTDGVLLGTTQLSPVNICTFRGDVTQIASTQTYTMNLASLNWNNYDPTEEIPAPLGAPDFMGKIQGVLTQTTRQDGSTRGHKATVSTGSVHFTPKLGSVRFDTDTNNNLQPHQSTRFTPVGVIQDGDTHQNEPQQWVLPCYSGRDVNNVHLAPAVAPSFPGEQLLFFRSTMPGCSGYPNMDLDCLLPQEWVQHFYQEAAPAQSDVALLRFVNPDTGRVLFECKLHKSGYVTVAHTGQHNLVIPPNGYFRFDSWVNQFYTLAPMGNGTGRRRV

SEQ ID NO: 3067 - protein, 538 aa, Artificial Sequence
  VP1__Norovirus_and/or_Norovirus-like__KR904236
MKMASSDANSSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTKTDGSTRGHKATVYTGSADFAPKLGRVQFATDTDNDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGPHDLVIPPNGYFRFDSWVNQFYTLAPMGNGTGRRR

SEQ ID NO: 3068 - protein, 538 aa, Artificial Sequence
  VP1__Norovirus_and/or_Norovirus-like__KR904225
MKMASSDANPSEGSTASLVPEVNNEVMALEPVAGAAIAAPVAGQVNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNEPTIKLVAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHISGSRNHTMNLASQNWNSYDPTEEIPAPLGTPDFVGKIQGVLTQTTRSDGSTRGHKATVYTGSADFSPKLGRIQFATDTDNDFETNQNTKFTPVGVIQDGGTTHRNEPQQWVLPTYSGRNTHNVHLAPAVAPTFPGEQLLFFRSTMPGCSGYPDMDLDCLLPQEWVQHFYQEAAPAQSDVALLRFVNPDTGRVLFECKLHKAGYVTVAHTGQHDLVIPPNGYFRFDSWVNQFFTLAPMGNGTGRRR

SEQ ID NO: 3069 - protein, 538 aa, Artificial Sequence
  VP1__Norovirus_and/or_Norovirus-like__LC005710
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPTLTVEEMTNSRFPIPLEKLFTGPSSAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3070 - protein, 538 aa, Artificial Sequence
  VP1__Norovirus_and/or_Norovirus-like__LC018709
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTGESRTKPFSVPVLTVEEMTNSRFPIPLEKLFTGPSSAFVVQPQNGRCTTDGVLLGTTQLSPVNICTFRGDVTHTTGSHNYTMNLASQNWNNYDPTEEIPAPLGTPDFVGKIQGMLTQTTRTDGSTRGHKATVYTGSADFAPKLGRVQFGTDTDHDLEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3071 - protein, 538 aa, Artificial Sequence
  VP1__Norovirus_and/or_Norovirus-like__KM198587
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3072 - protein, 538 aa, Artificial Sequence
  VP1__Norovirus_and/or_Norovirus-like__KM198560
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3073 - protein, 538 aa, Artificial Sequence
  VP1__Norovirus_and/or_Norovirus-like__KM198521
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICAFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3074 - protein, 538 aa, Artificial Sequence
  VP1__Norovirus_and/or_Norovirus-like__KM198490
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDITHIAGSRDYTMNLASLNWNNYDPTEEIPAPLGTPDFVGKIQGVLTQTTKRDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3075 - protein, 538 aa, Artificial Sequence
  VP1__Norovirus_and/or_Norovirus-like__KC409241
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRDVHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3076 - protein, 538 aa, Artificial Sequence
  VP1__Norovirus_and/or_Norovirus-like__JX459625
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3077 - protein, 538 aa, Artificial Sequence
  VP1__Norovirus_and/or_Norovirus-like__JX459613
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3078 - protein, 538 aa, Artificial Sequence
  VP1__Norovirus_and/or_Norovirus-like__JX459600
MKMASNDANPSDGSAAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3079 - protein, 538 aa, Artificial Sequence
  VP1__Norovirus_and/or_Norovirus-like__JX459596
MKMASNDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3080 - protein, 538 aa, Artificial Sequence
  VP1__Norovirus_and/or_Norovirus-like__JX155749
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 3081 - protein, 538 aa, Artificial Sequence
  VP1__Norovirus_and/or_Norovirus-like__JQ613511
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3082 - protein, 538 aa, Artificial Sequence
  VP1__Norovirus_and/or_Norovirus-like__HM802547
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGSRNYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3083 - protein, 538 aa, Artificial Sequence
  VP1__Norovirus_and/or_Norovirus-like__HM802544
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3084 - protein, 538 aa, Artificial Sequence
  VP1__Norovirus_and/or_Norovirus-like__GQ856456
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVGVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFKGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3085 - protein, 538 aa, Artificial Sequence
  VP1__Norovirus_and/or_Norovirus-like__AB541332
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSAQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3086 - protein, 538 aa, Artificial Sequence
  VP1__Norovirus_and/or_Norovirus-like__AB541316
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMDLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3087 - protein, 538 aa, Artificial Sequence
  VP1__Norovirus_and/or_Norovirus-like__AB541238
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3088 - protein, 538 aa, Artificial Sequence
  VP1__Norovirus_and/or_Norovirus-like__AB535750
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTRIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3089 - protein, 538 aa, Artificial Sequence
  VP1__Norovirus_and/or_Norovirus-like__FJ538900
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPAEEIPAPLGTPDFVGRIQGVLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3090 - protein, 538 aa, Artificial Sequence
  VP1__Norovirus_and/or_Norovirus-like__EU876889
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3091 - protein, 538 aa, Artificial Sequence
  VP1__Norovirus_and/or_Norovirus-like__EU876887
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPSYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 3092 - protein, 538 aa, Artificial Sequence
  VP1__Norovirus_and/or_Norovirus-like__FJ411171
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTRRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKSGYVTVAHTGQHDLVIPPNGYFRFDSWVNQFYTLAPMGNGAGRRR

SEQ ID NO: 3093 - protein, 538 aa, Artificial Sequence
  VP1__Norovirus_and/or_Norovirus-like__AB447460
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNSYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3094 - protein, 538 aa, Artificial Sequence
  VP1__Norovirus_and/or_Norovirus-like__AB447454
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3095 - protein, 538 aa, Artificial Sequence
  VP1__Norovirus_and/or_Norovirus-like__AB447443
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEELPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3096 - protein, 538 aa, Artificial Sequence
  VP1__Norovirus_and/or_Norovirus-like__AB447430
MKMASNDANPSDGSTANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAKVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3097 - protein, 538 aa, Artificial Sequence
  VP1__Norovirus_and/or_Norovirus-like__EU078420
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFHQEAAPAQSDVALLRFVNPDTGRVLFECKLHKSGYVTVAHTGQHDLVIPPNGYFRFDSWVNQFYTLAPMGNGTGRRR

SEQ ID NO: 3098 - protein, 538 aa, Artificial Sequence
  VP1__Norovirus_and/or_Norovirus-like__AB385637
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3099 - protein, 538 aa, Artificial Sequence
  VP1__Norovirus_and/or_Norovirus-like__EF202568
MKMASNDATPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSSFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTPQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3100 - protein, 538 aa, Artificial Sequence
  VP1__Norovirus_and/or_Norovirus-like__AB294781
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPVLTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTKGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3101 - protein, 538 aa, Artificial Sequence
  VP1__Norovirus_and/or_Norovirus-like__AB303940
MKMASNDATPSDGSTANLVPEVNTEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRTNNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSIHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3102 - protein, 538 aa, Artificial Sequence
  VP1__Norovirus_and/or_Norovirus-like__DQ415279
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHVIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3103 - protein, 538 aa, Artificial Sequence
  VP1__Norovirus_and/or_Norovirus-like__DQ078794
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEVLSPSQVTMFPHIIVDVRQLEPVLIPLPDVRNNLYHYNQSNDPTIRLIAMLYTPLRANNAGDDVFTVSCRVLTRPSPDFDFMFLVPPTVESRTKPFSVPILTVEEMTNSRFPIPLEKLFTGPSSAFVVQPQNGRCTTDGVLLGTTQLSPVNICTFRGDVTHIAGAQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWINQFYTLAPMGNGAGRRR

SEQ ID NO: 3104 - protein, 538 aa, Artificial Sequence
  VP1__Norovirus_and/or_Norovirus-like__KP784691
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTHNYTMNLASQNWNNYDPTEEIPAPLGTPDFVGKIQGVLTQTTRGDGSTRGHKATVSTGDAHFTPKLGSVMFSTDTNNDFETGQNTRFTPVGVVQDGSTTHQNEPQQWVLPSYLGRDSHNVHLAPAVAPSFPGEQLLFFRSTMPGCSGYPNMNMDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3105 - protein, 538 aa, Artificial Sequence
  VP1__Norovirus_and/or_Norovirus-like__KX907727
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKAIVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3106 - protein, 538 aa, Artificial Sequence
  VP1__Norovirus_and/or_Norovirus-like__KX354049
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRADGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3107 - protein, 538 aa, Artificial Sequence
  VP1__Norovirus_and/or_Norovirus-like__KX354024
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3108 - protein, 538 aa, Artificial Sequence
  VP1__Norovirus_and/or_Norovirus-like__KX353955
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3109 - protein, 538 aa, Artificial Sequence
  VP1__Norovirus_and/or_Norovirus-like__AB972518
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRTTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3110 - protein, 538 aa, Artificial Sequence
  VP1__Norovirus_and/or_Norovirus-like__AB933744
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRR

SEQ ID NO: 3111 - protein, 538 aa, Artificial Sequence
  VP1__Norovirus_and/or_Norovirus-like__AB933673
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGQIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3112 - protein, 538 aa, Artificial Sequence
  VP1__Norovirus_and/or_Norovirus-like__KM245070
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3113 - protein, 538 aa, Artificial Sequence
  VP1__Norovirus_and/or_Norovirus-like__EU921382
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3114 - protein, 538 aa, Artificial Sequence
  VP1__Norovirus_and/or_Norovirus-like__KP293589
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEDIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3115 - protein, 538 aa, Artificial Sequence
  VP1__Norovirus_and/or_Norovirus-like__KP241908
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3116 - protein, 538 aa, Artificial Sequence
  VP1__Norovirus_and/or_Norovirus-like__KJ451059
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3117 - protein, 538 aa, Artificial Sequence
  VP1__Norovirus_and/or_Norovirus-like__KM198570
MKMASNDANPSDGSAANLVPEVSNEVMALEPVVGAAIAAPVAGQQNVIDPWIRNNFVQAPGGEFTVSPRNAPGEILWGAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHNGQHDLVIPPNGYFRFDSWVNQFYTLAPMGNGTGRRR

SEQ ID NO: 3118 - protein, 538 aa, Artificial Sequence
  VP1__Norovirus_and/or_Norovirus-like__KM198558
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGVLTQTTRGDGSTRGHKATVYTGSAPFAPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3119 - protein, 538 aa, Artificial Sequence
  VP1__Norovirus_and/or_Norovirus-like__AB447456
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3120 - protein, 538 aa, Artificial Sequence
  VP1__Norovirus_and/or_Norovirus-like__KF177444
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVIDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3121 - protein, 538 aa, Artificial Sequence
  VP1__Norovirus_and/or_Norovirus-like__KF429776
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3122 - protein, 538 aa, Artificial Sequence
  VP1__Norovirus_and/or_Norovirus-like__KC243078
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSEVALLRFVNPDTGRVLFECKLHKSGYVTVAHTGQYDLVIPPNGYFRFDSWVNQFYTLAPMGNGTGRRR

SEQ ID NO: 3123 - protein, 538 aa, Artificial Sequence
  VP1__Norovirus_and/or_Norovirus-like__KC409280
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKEDGSTRGHKATVYTGSAPFTPKLGSVQFSTDTENDFETHQNTKFTPVGVIQDGGTTHRNEPQQWVLPSYSGRDVHNVHLAPAVAPTFPGEQILFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3124 - protein, 538 aa, Artificial Sequence
  VP1__Norovirus_and/or_Norovirus-like__KC175357
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3125 - protein, 538 aa, Artificial Sequence
  VP1__Norovirus_and/or_Norovirus-like__JX459621
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVAHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3126 - protein, 538 aa, Artificial Sequence
  VP1__Norovirus_and/or_Norovirus-like__JQ613541
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAVVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSAEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHIGQHDLVIPPNGYFRFDSWVNQFYTLAPMGNGTGRRR

SEQ ID NO: 3127 - protein, 538 aa, Artificial Sequence
  VP1__Norovirus_and/or_Norovirus-like__JQ613527
MKMASSDANPSDGSTANLVPEVNNEVMALEPVVGAAIAAPVAGQQNVIDPWVRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSTEFSPKLGRVQFATDTNNDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3128 - protein, 538 aa, Artificial Sequence
  VP1__Norovirus_and/or_Norovirus-like__JF827296
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNVFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLAPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSIQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3129 - protein, 538 aa, Artificial Sequence
  VP1__Norovirus_and/or_Norovirus-like__JF713050
MKMASNDANPSDGSAANLVPEVNNEVMALEPVAGAALAAPVAGQQNVIDPWIRNNFVQAPGGEFTVSPRNAPGEILWSAPLSPDLNPYLSHLARMYNSYAGGFEVQVILAGNAFTAGKIIFAAVPPNFPIEGLSPSQVTMFPHIIVDVRQLEPVLIPLPDVRNNFYHYNQSNEPTIKLIAMLYTPLRANNAGEDVFTVSCRVLTRPSPDFDFIFLVPPTVESRTKPFTVPILTVEEMTNSRFPIPLEKLFTGPSSSFVVQPQNGRCTTDGVLLGTTQLSPVNICTFRGDVTHIAGSRNYTMNLASINWNNYDPTEEIPAPLGTPDFVGKIQGMLTQTTRGDGSTRGHRATVYTGSAPFTPKLGSVQFTTDTDNDFETNQNTKFTPVGVVQDGDTAHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3130 - protein, 538 aa, Artificial Sequence
  VP1__Norovirus_and/or_Norovirus-like__HM802548
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRSYRMNLASQNWNNYDPTEEIPAPLGTPDFVGKIQGMLTQTTKRDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3131 - protein, 538 aa, Artificial Sequence
  VP1__Norovirus_and/or_Norovirus-like__GQ856459
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQMILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHGLVIPPNGYFRFDSWVNQFYTLAPMGNGTGRRR

SEQ ID NO: 3132 - protein, 538 aa, Artificial Sequence
  VP1__Norovirus_and/or_Norovirus-like__AB541308
MKMASNDANPSDGSAANLVPEVNNEVMALDPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFICLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3133 - protein, 538 aa, Artificial Sequence
  VP1__Norovirus_and/or_Norovirus-like__AB541276
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3134 - protein, 538 aa, Artificial Sequence
  VP1__Norovirus_and/or_Norovirus-like__AB541224
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3135 - protein, 538 aa, Artificial Sequence
  VP1__Norovirus_and/or_Norovirus-like__AB504330
MKMASNDANPSDGSAANLVPEVNNEVMALEPVVGAAIAAPVAGQTNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFLIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3136 - protein, 538 aa, Artificial Sequence
  VP1__Norovirus_and/or_Norovirus-like__AB447445
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTDGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3137 - protein, 538 aa, Artificial Sequence
  VP1__Norovirus_and/or_Norovirus-like__AB294793
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3138 - protein, 538 aa, Artificial Sequence
  VP1__Norovirus_and/or_Norovirus-like__AB303934
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVIQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYITVAHTGQHDLVIPPNGYFRFDSWVNQFYTLAPMGNGTGRRR

SEQ ID NO: 3139 - protein, 538 aa, Artificial Sequence
  VP1__Norovirus_and/or_Norovirus-like__KU678205
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKVQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3140 - protein, 538 aa, Artificial Sequence
  VP1__Norovirus_and/or_Norovirus-like__LC177657
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALVRFVNPDTGRVLFECKLHKSGYVTVAHTGQHDLVIPPNGYFRFDSWVNQFYTLAPMGNGTGRRR

SEQ ID NO: 3141 - protein, 538 aa, Artificial Sequence
  VP1__Norovirus_and/or_Norovirus-like__LC177656
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRIDGSTRGHKATVYTGSADFAPKLGRVQFETDTDHDFEANQSTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3142 - protein, 538 aa, Artificial Sequence
  VP1__Norovirus_and/or_Norovirus-like__KX354136
MKMASSDANPSDGSAANLVPEVSNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRSDGSTRGHKATVYTGSADFAPKLGRVQFETDTDRDFETNQNTKFTPVGVIQDGTTAHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3143 - protein, 538 aa, Artificial Sequence
  VP1__Norovirus_and/or_Norovirus-like__KX354121
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDITHITGSHNYTMNLASQNWNNYDPTEEIPAPLGTPDFVGKIQGVLTQTTRTDGSTRGHKATVYTGSAEFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3144 - protein, 538 aa, Artificial Sequence
  VP1__Norovirus_and/or_Norovirus-like__KX354110
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDVTHITGSHNYTMNLASQNWNNYDPTEEIPAPLGTPDFVGKIQGVLTQTTSTDGSTRGHKATVYTGSAEFAPKLGRVQFETDTDHDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3145 - protein, 538 aa, Artificial Sequence
  VP1__Norovirus_and/or_Norovirus-like__KX354107
MKMASSDANPSDGSAANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3146 - protein, 538 aa, Artificial Sequence
  VP1__Norovirus_and/or_Norovirus-like__KX353991
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRIPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3147 - protein, 538 aa, Artificial Sequence
  VP1__Norovirus_and/or_Norovirus-like__KU985162
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3148 - protein, 538 aa, Artificial Sequence
  VP1__Norovirus_and/or_Norovirus-like__AB972476
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3149 - protein, 538 aa, Artificial Sequence
  VP1__Norovirus_and/or_Norovirus-like__KU311162
MKMASNDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRTKPFTVPILTVEEMTNSRFPIPLEKLFTGPSNAFVVQPQNGRCTTDGVLLGTTQLSPVNICTFRGDVTQIASTQTYTMNLASLNWNNYDPTEEIPAPLGAPDFMGKIQGVLTQTTRQGGSTRGHKATVSTGSVHFTPKLGSVRFDTDTNNDLQPHQSTRFTPVGVIQDGDTHQNEPQQWALPCYSGRDVNNVHLAPAVAPSFPGEQLLFFRSTMPGCSGYPNMDLDCLLPQEWVQHFYQEAAPAQSDVALLRFVNPDTGRVLFECKLHKSGYVTVAHTGQHNLVIPPNGYFRFDSWVNQFYTLAPMGNGTGRRRV

SEQ ID NO: 3150 - protein, 538 aa, Artificial Sequence
  VP1__Norovirus_and/or_Norovirus-like__KR904212
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKITFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHITGSHNYTMNLASQNWSSYDPTEEIPAPLGTPDFVGKIQGVLTQTTRTDGSTRGHKATVFTGSADFSPKLGRVQFATDTDNDFVANQNTKFTPVGVIQDGGTAHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3151 - protein, 538 aa, Artificial Sequence
  VP1__Norovirus_and/or_Norovirus-like__AB933678
MKMASNDANPFDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPAEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3152 - protein, 538 aa, Artificial Sequence
  VP1__Norovirus_and/or_Norovirus-like__AB933648
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3153 - protein, 538 aa, Artificial Sequence
  VP1__Norovirus_and/or_Norovirus-like__LN854571
MKMASNDAAPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3154 - protein, 538 aa, Artificial Sequence
  VP1__Norovirus_and/or_Norovirus-like__EU921384
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3155 - protein, 538 aa, Artificial Sequence
  VP1__Norovirus_and/or_Norovirus-like__LC005716
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSGNYTMNLASVNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3156 - protein, 538 aa, Artificial Sequence
  VP1__Norovirus_and/or_Norovirus-like__KP241914
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDRDFEANQNTKFTPVGVIQDGGTTHRNEPQQWVLPSYSGRNAPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3157 - protein, 538 aa, Artificial Sequence
  VP1__Norovirus_and/or_Norovirus-like__KJ433968
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLPGTTQLSPVNICTFRGDVTHITGSRNYTMNLASQNWNNYDPTEEIPAPLGTPDFVGKIQGVLTQTTRSDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3158 - protein, 538 aa, Artificial Sequence
  VP1__Norovirus_and/or_Norovirus-like__KP176409
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3159 - protein, 538 aa, Artificial Sequence
  VP1__Norovirus_and/or_Norovirus-like__KM514064
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3160 - protein, 538 aa, Artificial Sequence
  VP1__Norovirus_and/or_Norovirus-like__KJ649703
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFSPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3161 - protein, 538 aa, Artificial Sequence
  VP1__Norovirus_and/or_Norovirus-like__KF177447
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYIMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3162 - protein, 538 aa, Artificial Sequence
  VP1__Norovirus_and/or_Norovirus-like__JX439820
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISSSRNYTMNLASQNWSSYDPTEEIPAPLGTPDFVGKIQGVLTQTTRTDGSTRGHKATVYTGSADFSPKLGRVQFDTDTDNDFETNQNTKFTPVGVIQDGSTTYRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3163 - protein, 538 aa, Artificial Sequence
  VP1__Norovirus_and/or_Norovirus-like__HF952120
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLVPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFEANQNTKFTPVGVIQDGSTAHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3164 - protein, 538 aa, Artificial Sequence
  VP1__Norovirus_and/or_Norovirus-like__KC517369
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFATVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3165 - protein, 538 aa, Artificial Sequence
  VP1__Norovirus_and/or_Norovirus-like__KC409293
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3166 - protein, 538 aa, Artificial Sequence
  VP1__Norovirus_and/or_Norovirus-like__JX984951
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVRFSTDTENDFETHQNTKFTPVGVIQDGGTTHRNEPQQWVLPNYSGSDVPNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3167 - protein, 538 aa, Artificial Sequence
  VP1__Norovirus_and/or_Norovirus-like__JX459612
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTSRDGSTRGHKATVSTGSVHFTPKLGRVQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3168 - protein, 538 aa, Artificial Sequence
  VP1__Norovirus_and/or_Norovirus-like__JX459604
MKMASNDVTPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3169 - protein, 538 aa, Artificial Sequence
  VP1__Norovirus_and/or_Norovirus-like__JX155745
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTRGDGSTRGHKATVYTGSAPFTPKMGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3170 - protein, 538 aa, Artificial Sequence
  VP1__Norovirus_and/or_Norovirus-like__HM635155
MKMASSDTKTSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTIDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3171 - protein, 538 aa, Artificial Sequence
  VP1__Norovirus_and/or_Norovirus-like__JN400620
MKMASNDVNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3172 - protein, 538 aa, Artificial Sequence
  VP1__Norovirus_and/or_Norovirus-like__JQ613573
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPSSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGSTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3173 - protein, 538 aa, Artificial Sequence
  VP1__Norovirus_and/or_Norovirus-like__JQ478408
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3174 - protein, 538 aa, Artificial Sequence
  VP1__Norovirus_and/or_Norovirus-like__EF684915
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLKWNKYDPTEEIPAPLGTPDFVGKIQGVLTQTTKGDGSTRGHKATIYTGSAPFTPKLGSVQFSTDTENDFETHQNTKFTPVGVTQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3175 - protein, 538 aa, Artificial Sequence
  VP1__Norovirus_and/or_Norovirus-like__HQ456331
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3176 - protein, 538 aa, Artificial Sequence
  VP1__Norovirus_and/or_Norovirus-like__HQ456322
MKIASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIASTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3177 - protein, 538 aa, Artificial Sequence
  VP1__Norovirus_and/or_Norovirus-like__HM802551
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGSRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3178 - protein, 538 aa, Artificial Sequence
  VP1__Norovirus_and/or_Norovirus-like__HM802546
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3179 - protein, 538 aa, Artificial Sequence
  VP1__Norovirus_and/or_Norovirus-like__GQ856453
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQAILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSLQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3180 - protein, 538 aa, Artificial Sequence
  VP1__Norovirus_and/or_Norovirus-like__GQ856445
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQSGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNVDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3181 - protein, 538 aa, Artificial Sequence
  VP1__Norovirus_and/or_Norovirus-like__AB541358
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVLILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAYTGQHDLVIPPNGYFRFDSWVNQFYTLAPMGNGTGRRR

SEQ ID NO: 3182 - protein, 538 aa, Artificial Sequence
  VP1__Norovirus_and/or_Norovirus-like__AB541349
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTIHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3183 - protein, 538 aa, Artificial Sequence
  VP1__Norovirus_and/or_Norovirus-like__AB541342
MKMASNDANPSDGSAANLVPEVNNEVMALEPVVGAAIAAPVAGQTNVIDPWIRNNFVQAPGGEFTVSPRNAPGEILWSAPSGPDLNPYLSHLARMFNDYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGSTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3184 - protein, 538 aa, Artificial Sequence
  VP1__Norovirus_and/or_Norovirus-like__AB541248
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3185 - protein, 538 aa, Artificial Sequence
  VP1__Norovirus_and/or_Norovirus-like__GQ246798
MKMASSDANPFDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGNTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3186 - protein, 538 aa, Artificial Sequence
  VP1__Norovirus_and/or_Norovirus-like__GQ246791
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPRIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWNNYDPTEEIPAPLGTPDFVGKIQGMLTQTTRSDGSTRGHKATVLTGSADFAPKLGRVQFATDTDNDFESGQNTKFTPVGVIQDGSTTHRNEPQQWVLPNYSGRTGHNVHLAPAVAPTYPGEQLLFFRSTMPGCSGYPNMDLDCLIPQDWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3187 - protein, 538 aa, Artificial Sequence
  VP1__Norovirus_and/or_Norovirus-like__GU350225
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTAHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3188 - protein, 538 aa, Artificial Sequence
  VP1__Norovirus_and/or_Norovirus-like__AB504319
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEVTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3189 - protein, 538 aa, Artificial Sequence
  VP1__Norovirus_and/or_Norovirus-like__AB447458
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3190 - protein, 538 aa, Artificial Sequence
  VP1__Norovirus_and/or_Norovirus-like__AB385640
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNSYAGGFEVQVILAGNAFTAGKIIFAAVPPNFPIEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPTPVEKLFTGPSSAFIVQPQNGRCTIDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETRQNTRFTPVGVIQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVMFECKLHKSGYITVAHTGQHDLVIPPNGYFRFDAWVNQFYTLAPMGNGTGRRR

SEQ ID NO: 3191 - protein, 538 aa, Artificial Sequence
  VP1__Norovirus_and/or_Norovirus-like__AB385633
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFIVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYLGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3192 - protein, 538 aa, Artificial Sequence
  VP1__Norovirus_and/or_Norovirus-like__DQ658413
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIADTHNYTMNLASQNWNNYDPTEEIPAPLGTPDFVGKIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3193 - protein, 538 aa, Artificial Sequence
  VP1__Norovirus_and/or_Norovirus-like__AB220923
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3194 - protein, 538 aa, Artificial Sequence
  VP1__Norovirus_and/or_Norovirus-like__AY588016
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSAMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3195 - protein, 538 aa, Artificial Sequence
  VP1__Norovirus_and/or_Norovirus-like__AY502022
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3196 - protein, 538 aa, Artificial Sequence
  VP1__Norovirus_and/or_Norovirus-like__KX158280
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3197 - protein, 538 aa, Artificial Sequence
  VP1__Norovirus_and/or_Norovirus-like__KX371606
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3198 - protein, 538 aa, Artificial Sequence
  VP1__Norovirus_and/or_Norovirus-like__KX371605
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQSTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3199 - protein, 538 aa, Artificial Sequence
  VP1__Norovirus_and/or_Norovirus-like__KX354128
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3200 - protein, 538 aa, Artificial Sequence
  VP1__Norovirus_and/or_Norovirus-like__KX354099
MKMASSDASPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQLNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRADGSTRGHKATVYTGSADFAPKLGRVQFETDTDHDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3201 - protein, 538 aa, Artificial Sequence
  VP1__Norovirus_and/or_Norovirus-like__KX354087
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKLFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFEIHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRR

SEQ ID NO: 3202 - protein, 538 aa, Artificial Sequence
  VP1__Norovirus_and/or_Norovirus-like__KX354009
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3203 - protein, 538 aa, Artificial Sequence
  VP1__Norovirus_and/or_Norovirus-like__KR131784
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNMASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3204 - protein, 538 aa, Artificial Sequence
  VP1__Norovirus_and/or_Norovirus-like__AB972527
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRYTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3205 - protein, 538 aa, Artificial Sequence
  VP1__Norovirus_and/or_Norovirus-like__AB972525
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTVPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3206 - protein, 538 aa, Artificial Sequence
  VP1__Norovirus_and/or_Norovirus-like__KT780388
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRTDGSTRGHKATVYTGSADFAPKLGRVQFATDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3207 - protein, 538 aa, Artificial Sequence
  VP1__Norovirus_and/or_Norovirus-like__KT780373
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFATDTDHDFVANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3208 - protein, 538 aa, Artificial Sequence
  VP1__Norovirus_and/or_Norovirus-like__AB933723
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIASSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPAFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3209 - protein, 538 aa, Artificial Sequence
  VP1__Norovirus_and/or_Norovirus-like__AB933708
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3210 - protein, 538 aa, Artificial Sequence
  VP1__Norovirus_and/or_Norovirus-like__LC066046
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3211 - protein, 538 aa, Artificial Sequence
  VP1__Norovirus_and/or_Norovirus-like__KJ678140
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHVVIDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3212 - protein, 538 aa, Artificial Sequence
  VP1__Norovirus_and/or_Norovirus-like__KJ678139
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3213 - protein, 538 aa, Artificial Sequence
  VP1__Norovirus_and/or_Norovirus-like__EU921383
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3214 - protein, 538 aa, Artificial Sequence
  VP1__Norovirus_and/or_Norovirus-like__KP176405
MKMASSDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3215 - protein, 538 aa, Artificial Sequence
  VP1__Norovirus_and/or_Norovirus-like__KP176403
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTRFTPVGVIQDGGTTHRNEPQQWVLPSYSGRNTPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3216 - protein, 538 aa, Artificial Sequence
  VP1__Norovirus_and/or_Norovirus-like__KP096343
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3217 - protein, 538 aa, Artificial Sequence
  VP1__Norovirus_and/or_Norovirus-like__KM268101
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3218 - protein, 538 aa, Artificial Sequence
  VP1__Norovirus_and/or_Norovirus-like__KM198568
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGGVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3219 - protein, 538 aa, Artificial Sequence
  VP1__Norovirus_and/or_Norovirus-like__KM198532
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPVPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3220 - protein, 538 aa, Artificial Sequence
  VP1__Norovirus_and/or_Norovirus-like__KM198527
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3221 - protein, 538 aa, Artificial Sequence
  VP1__Norovirus_and/or_Norovirus-like__KF177448
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3222 - protein, 538 aa, Artificial Sequence
  VP1__Norovirus_and/or_Norovirus-like__KF008244
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3223 - protein, 538 aa, Artificial Sequence
  VP1__Norovirus_and/or_Norovirus-like__KF060103
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3224 - protein, 538 aa, Artificial Sequence
  VP1__Norovirus_and/or_Norovirus-like__KC960615
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3225 - protein, 538 aa, Artificial Sequence
  VP1__Norovirus_and/or_Norovirus-like__KC517373
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSGFPIPLEKLFTGPSSAFVVQPQNGRCTTDGVLLGTTQLSPVNICTFRGDVTHIAGSRNYTMNLASLNWNNYDPTEEIPAPLGTPDFVGKVQGVLTQTTKGDGSTRGHKATVYTGSAPFTPKLGSVQFETDTENDFETHQNTKFTPVGVIQDGGTAHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQRDLVIPPNGYFRFDSWVNQFYTLAPMGNGTGRRR

SEQ ID NO: 3226 - protein, 538 aa, Artificial Sequence
  VP1__Norovirus_and/or_Norovirus-like__JX459615
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPEFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3227 - protein, 538 aa, Artificial Sequence
  VP1__Norovirus_and/or_Norovirus-like__JX459603
MKMASNDATPSDGVAAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3228 - protein, 538 aa, Artificial Sequence
  VP1__Norovirus_and/or_Norovirus-like__JX155746
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 3229 - protein, 538 aa, Artificial Sequence
  VP1__Norovirus_and/or_Norovirus-like__AB541333
MKMASNDANPSDGSAANLVPEVNNEVMALEPVVGAAIAAPVAGQQNVIDPWIRNNFVQAPGGEFTVSPRNAPGEILWSAPLDPDLNPYLSQLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3230 - protein, 538 aa, Artificial Sequence
  VP1__Norovirus_and/or_Norovirus-like__AB541220
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLYKSGYVTVAHTGQHDLVIPPNGYFRFDSWVNQFYTLAPMGNGTGRRR

SEQ ID NO: 3231 - protein, 538 aa, Artificial Sequence
  VP1__Norovirus_and/or_Norovirus-like__AB504312
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECELHKSGYVTVAHTGQHDLVIPPNGYFRFDSWVNQFYTLAPMGNGAGRRR

SEQ ID NO: 3232 - protein, 538 aa, Artificial Sequence
  VP1__Norovirus_and/or_Norovirus-like__GQ849126
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGNVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3233 - protein, 538 aa, Artificial Sequence
  VP1__Norovirus_and/or_Norovirus-like__AB447459
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLIFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3234 - protein, 538 aa, Artificial Sequence
  VP1__Norovirus_and/or_Norovirus-like__EU078413
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASQNWNNYDPTEEIPAPLGTPDFVGRIQGMLTQTTRRDGSTRGHKATVSTGDAHFTPKLGSIMFSTDTDNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3235 - protein, 538 aa, Artificial Sequence
  VP1__Norovirus_and/or_Norovirus-like__EU078411
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3236 - protein, 538 aa, Artificial Sequence
  VP1__Norovirus_and/or_Norovirus-like__AB385632
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEVPAPLGTPDFMGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVSPDTGRVLFECKLHKSGYVTVAHTGQHDLVIPPNGYFRFDSWVNQFYTLAPMGNGTGRRR

SEQ ID NO: 3237 - protein, 538 aa, Artificial Sequence
  VP1__Norovirus_and/or_Norovirus-like__EU839595
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPGFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3238 - protein, 538 aa, Artificial Sequence
  VP1__Norovirus_and/or_Norovirus-like__AB294788
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTTRDGSTRGHKATVSTGSVHFTPKLGSVQFSTDTSNDFETGQNTRFTPVGVVQDGSTTHQNEPQQWVLPDYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3239 - protein, 538 aa, Artificial Sequence
  VP1__Norovirus_and/or_Norovirus-like__AB303936
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFDTDTNSDFETGQNTKFTPVGVVQDGNGAHQNEPQQWVLPSYSGRTGHNAHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3240 - protein, 538 aa, Artificial Sequence
  VP1__Norovirus_and/or_Norovirus-like__AB303935
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3241 - protein, 538 aa, Artificial Sequence
  VP1__Norovirus_and/or_Norovirus-like__AY588018
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3242 - protein, 538 aa, Artificial Sequence
  VP1__Norovirus_and/or_Norovirus-like__KU678203
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3243 - protein, 538 aa, Artificial Sequence
  VP1__Norovirus_and/or_Norovirus-like__KP176410
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNTDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3244 - protein, 538 aa, Artificial Sequence
  VP1__Norovirus_and/or_Norovirus-like__KX371609
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTRGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3245 - protein, 538 aa, Artificial Sequence
  VP1__Norovirus_and/or_Norovirus-like__KX354130
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDITHITGSHNYTMNLASQNWNNYDPTEEIPAPLGTPDFVGKIQGVLTQTTRTDGSTRGHKATVYTGSAEFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRKR

SEQ ID NO: 3246 - protein, 538 aa, Artificial Sequence
  VP1__Norovirus_and/or_Norovirus-like__KX354120
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEVNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3247 - protein, 538 aa, Artificial Sequence
  VP1__Norovirus_and/or_Norovirus-like__KX354113
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3248 - protein, 538 aa, Artificial Sequence
  VP1__Norovirus_and/or_Norovirus-like__KX354105
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3249 - protein, 538 aa, Artificial Sequence
  VP1__Norovirus_and/or_Norovirus-like__KX354077
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTRGDGSTRGHKATVYTGSAPFTPKLGSVQFETDTENDFETHQNTKFTPVGVIQDGGTTHRNEPQQWVLPSYSGRSVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3250 - protein, 538 aa, Artificial Sequence
  VP1__Norovirus_and/or_Norovirus-like__KR131785
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3251 - protein, 538 aa, Artificial Sequence
  VP1__Norovirus_and/or_Norovirus-like__AB972530
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3252 - protein, 538 aa, Artificial Sequence
  VP1__Norovirus_and/or_Norovirus-like__AB972526
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3253 - protein, 538 aa, Artificial Sequence
  VP1__Norovirus_and/or_Norovirus-like__AB972522
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRIQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3254 - protein, 538 aa, Artificial Sequence
  VP1__Norovirus_and/or_Norovirus-like__AB972514
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSIMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3255 - protein, 538 aa, Artificial Sequence
  VP1__Norovirus_and/or_Norovirus-like__AB972505
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTAHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3256 - protein, 538 aa, Artificial Sequence
  VP1__Norovirus_and/or_Norovirus-like__AB972473
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3257 - protein, 538 aa, Artificial Sequence
  VP1__Norovirus_and/or_Norovirus-like__KT780381
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEDIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3258 - protein, 538 aa, Artificial Sequence
  VP1__Norovirus_and/or_Norovirus-like__KT780372
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3259 - protein, 538 aa, Artificial Sequence
  VP1__Norovirus_and/or_Norovirus-like__KT202797
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRSTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3260 - protein, 538 aa, Artificial Sequence
  VP1__Norovirus_and/or_Norovirus-like__KR904226
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRSAHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3261 - protein, 538 aa, Artificial Sequence
  VP1__Norovirus_and/or_Norovirus-like__KR904208
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFSAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGNTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNHFYTLAPVGNGTGRRR

SEQ ID NO: 3262 - protein, 538 aa, Artificial Sequence
  VP1__Norovirus_and/or_Norovirus-like__AB933709
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIHDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3263 - protein, 538 aa, Artificial Sequence
  VP1__Norovirus_and/or_Norovirus-like__EU921352
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPDYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3264 - protein, 538 aa, Artificial Sequence
  VP1__Norovirus_and/or_Norovirus-like__LC005735
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3265 - protein, 538 aa, Artificial Sequence
  VP1__Norovirus_and/or_Norovirus-like__KP241909
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNTDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3266 - protein, 538 aa, Artificial Sequence
  VP1__Norovirus_and/or_Norovirus-like__KJ533132
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQYDLVIPPNGYFRFDSWVNQFYTLAPMGNGTGRRR

SEQ ID NO: 3267 - protein, 538 aa, Artificial Sequence
  VP1__Norovirus_and/or_Norovirus-like__KP176407
MKMASSDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNRDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3268 - protein, 538 aa, Artificial Sequence
  VP1__Norovirus_and/or_Norovirus-like__KP176406
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3269 - protein, 538 aa, Artificial Sequence
  VP1__Norovirus_and/or_Norovirus-like__KP123606
MKMASSDANPSDGSAANLVPEVNNEVMALEPVVGATIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3270 - protein, 538 aa, Artificial Sequence
  VP1__Norovirus_and/or_Norovirus-like__KP096335
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLTSQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3271 - protein, 538 aa, Artificial Sequence
  VP1__Norovirus_and/or_Norovirus-like__KM268095
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3272 - protein, 538 aa, Artificial Sequence
  VP1__Norovirus_and/or_Norovirus-like__KM268094
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3273 - protein, 538 aa, Artificial Sequence
  VP1__Norovirus_and/or_Norovirus-like__KM268093
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3274 - protein, 538 aa, Artificial Sequence
  VP1__Norovirus_and/or_Norovirus-like__KM198591
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3275 - protein, 538 aa, Artificial Sequence
  VP1__Norovirus_and/or_Norovirus-like__KM198589
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEIHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHRSGYVTVAHTGQHDLVIPPNGYFRFDSWVNQFYTLAPMGNGTGRRR

SEQ ID NO: 3276 - protein, 538 aa, Artificial Sequence
  VP1__Norovirus_and/or_Norovirus-like__KM198576
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 3277 - protein, 538 aa, Artificial Sequence
  VP1__Norovirus_and/or_Norovirus-like__KM198564
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFIVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFEAHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3278 - protein, 538 aa, Artificial Sequence
  VP1__Norovirus_and/or_Norovirus-like__KJ716355
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3279 - protein, 538 aa, Artificial Sequence
  VP1__Norovirus_and/or_Norovirus-like__KJ685408
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHQNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3280 - protein, 538 aa, Artificial Sequence
  VP1__Norovirus_and/or_Norovirus-like__KJ144999
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPNYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 3281 - protein, 538 aa, Artificial Sequence
  VP1__Norovirus_and/or_Norovirus-like__KF060016
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3282 - protein, 538 aa, Artificial Sequence
  VP1__Norovirus_and/or_Norovirus-like__KC517367
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTASCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTAHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3283 - protein, 538 aa, Artificial Sequence
  VP1__Norovirus_and/or_Norovirus-like__KC517366
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNSASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3284 - protein, 538 aa, Artificial Sequence
  VP1__Norovirus_and/or_Norovirus-like__KC517359
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRRLEPVLIPLPDVRNNFYHYNQSNDSTIKLIAMLYTPLRANNAGEDVFTVSCRVLTRPSPDFDFIFLVPPTVESRTKPFTVPILTVEEMTYSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNIKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLIIPPNGYFRFDSWVNQFYTLAPMGNGTGRRR

SEQ ID NO: 3285 - protein, 538 aa, Artificial Sequence
  VP1__Norovirus_and/or_Norovirus-like__KC409303
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3286 - protein, 538 aa, Artificial Sequence
  VP1__Norovirus_and/or_Norovirus-like__JX459608
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3287 - protein, 538 aa, Artificial Sequence
  VP1__Norovirus_and/or_Norovirus-like__JQ320073
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3288 - protein, 538 aa, Artificial Sequence
  VP1__Norovirus_and/or_Norovirus-like__HM802552
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3289 - protein, 538 aa, Artificial Sequence
  VP1__Norovirus_and/or_Norovirus-like__AB541320
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVASRTKPFSVPSVTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPTVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3290 - protein, 538 aa, Artificial Sequence
  VP1__Norovirus_and/or_Norovirus-like__AB541227
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3291 - protein, 538 aa, Artificial Sequence
  VP1__Norovirus_and/or_Norovirus-like__AB504318
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGLLTQTTKGDGSTRGHKATVYTGSAPFTPKLGGVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3292 - protein, 538 aa, Artificial Sequence
  VP1__Norovirus_and/or_Norovirus-like__AB504311
MKMASNDATPSDGSTANLVPEVNNEVMALEPVVGAAIAAPVAGQQNVIDPWIRNNFVQAPGGEFTVSPRNAPGEILWSAPLGPDLNPYLSHLARTYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGVLTQTTRRDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3293 - protein, 538 aa, Artificial Sequence
  VP1__Norovirus_and/or_Norovirus-like__FJ537135
MKMASSDANPSDGSTANLVPEVNNEVMALEPVVGAAIAAPVAGQQNIIDPWIRNNFVQAPGGEFTVSPRNAPGEILWSAPLSPDLNPYLSHLSRMYNGYAGGFEVQVILAGNAFTAGKIIFAAIPPNFPTEGLSPSQVTMFPHIIVDVRQLEPVLIPLPDVRNNFYHYNQAHDSTLKLIAMLYTPLRANNAGDDVFTVSCRVLTRPSPDFDFIFLVPPTVESRTKPFTVPILTVEEMSNSRFPIPLEKLYTGPSSAFVVQPQNGRCTTDGVLLGTTQLSAVNICNFRGDVTRVGISHDYTMNLVSQNWNNYDPTEEIPAPLGTPDFVGKIQGLLTQTTRADGSTRAHKATVSTGSVHFTPKLGSVQFTTDTNNDFQTGQNTKFTPVGVIQDGDHHQNEPQQWVLPNYSGTSGHNVHLAPAVAPTFPGEQLLFFRSTMPGCSGYPNMNLDCLLPQEWVSHFYQEAAPAQSDVALLRFVNPDTGRVLFECKLHKSGYITVAHTGPYDLVIPPNGYFRFDSWVNQFYTLAPMGNGSGRKRV

SEQ ID NO: 3294 - protein, 538 aa, Artificial Sequence
  VP1__Norovirus_and/or_Norovirus-like__GQ413969
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFTVPILTVEEMTNSRFPIPLERLYTGPSSAFVVQPQNGRCTTDGVLLGTTQLSAVNICTFRGDVTHIAGSRNYTMNLASQNWSNYDPTEEIPAPLGTPDFVGKIQGMLTQTTGRDGSTRGHKATVLTGSADFAPKLGRVQFATDTDNDFESGENTKFTPVGVIQDGSTTHRNEPQQWVLPNYSGRTGHNVHLAPAVAPTYPGEQLLFFRSTMPGCSGYPNMDLDCLLPQEWVRHFYQEAAPAQSDVALLRFVNPDTGRVLFECKLHKPGYVTVAHTGQHDLVIPPNGYFRFDSWVNQFYTLAPMGNGTGRRR

SEQ ID NO: 3295 - protein, 538 aa, Artificial Sequence
  VP1__Norovirus_and/or_Norovirus-like__EU839592
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATAYTGSAPFTPKLGSVQFSTDTENDFETHQNTKFAPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3296 - protein, 538 aa, Artificial Sequence
  VP1__Norovirus_and/or_Norovirus-like__EU839587
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRAYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3297 - protein, 538 aa, Artificial Sequence
  VP1__Norovirus_and/or_Norovirus-like__EU839583
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3298 - protein, 538 aa, Artificial Sequence
  VP1__Norovirus_and/or_Norovirus-like__AB303931
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3299 - protein, 538 aa, Artificial Sequence
  VP1__Norovirus_and/or_Norovirus-like__KY341923
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSFPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3300 - protein, 538 aa, Artificial Sequence
  VP1__Norovirus_and/or_Norovirus-like__KX514317
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCTIDGELLGTTQLSSVNICTFRGDVTHPRDSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPNYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3301 - protein, 538 aa, Artificial Sequence
  VP1__Norovirus_and/or_Norovirus-like__KU678204
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3302 - protein, 538 aa, Artificial Sequence
  VP1__Norovirus_and/or_Norovirus-like__KX158283
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRLPIPLERLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSAEFAPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3303 - protein, 538 aa, Artificial Sequence
  VP1__Norovirus_and/or_Norovirus-like__KX354088
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKLFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGGTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQYDLVIPPNGYFRFDSWVNQFYTLAPMGNGTGRRR

SEQ ID NO: 3304 - protein, 538 aa, Artificial Sequence
  VP1__Norovirus_and/or_Norovirus-like__KX354032
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNVGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3305 - protein, 538 aa, Artificial Sequence
  VP1__Norovirus_and/or_Norovirus-like__KX354015
MKMASSDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQDWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3306 - protein, 538 aa, Artificial Sequence
  VP1__Norovirus_and/or_Norovirus-like__KX353999
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTSTDGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3307 - protein, 538 aa, Artificial Sequence
  VP1__Norovirus_and/or_Norovirus-like__KX353987
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3308 - protein, 538 aa, Artificial Sequence
  VP1__Norovirus_and/or_Norovirus-like__KX353970
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQYDLVIPPNGYFRFDSWVNQFYTLAPMGNGTGRRR

SEQ ID NO: 3309 - protein, 538 aa, Artificial Sequence
  VP1__Norovirus_and/or_Norovirus-like__KU985156
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3310 - protein, 538 aa, Artificial Sequence
  VP1__Norovirus_and/or_Norovirus-like__KU985155
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEVNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3311 - protein, 538 aa, Artificial Sequence
  VP1__Norovirus_and/or_Norovirus-like__KM514075
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3312 - protein, 538 aa, Artificial Sequence
  VP1__Norovirus_and/or_Norovirus-like__AB972484
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3313 - protein, 538 aa, Artificial Sequence
  VP1__Norovirus_and/or_Norovirus-like__KT780391
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3314 - protein, 538 aa, Artificial Sequence
  VP1__Norovirus_and/or_Norovirus-like__KT780390
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTTGSHNYTMNLASQNWSNYDPTEEIPAPLGTPDFVGKIQGVLTQTTRTDGSTRGHKATVYTGSADFAPKLGRVQFETDTDHDLEANQNTKFTPVGVIQDGGATHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3315 - protein, 538 aa, Artificial Sequence
  VP1__Norovirus_and/or_Norovirus-like__KT780376
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3316 - protein, 538 aa, Artificial Sequence
  VP1__Norovirus_and/or_Norovirus-like__KT780375
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDITHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3317 - protein, 538 aa, Artificial Sequence
  VP1__Norovirus_and/or_Norovirus-like__LC016607
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPNTHTYRMNLASQNWNNYDPTEEIPAPLGTPDFVGKIQGMLTQTTKGDGSTRGHKATVSTGSVDFTPKLGSVQFTTDTDNDFETGQNTRFTPVGVIQDGNGAHRNEPQQWVLPDYSGGTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3318 - protein, 538 aa, Artificial Sequence
  VP1__Norovirus_and/or_Norovirus-like__KP241915
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRADGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3319 - protein, 538 aa, Artificial Sequence
  VP1__Norovirus_and/or_Norovirus-like__KM514065
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSAGFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3320 - protein, 538 aa, Artificial Sequence
  VP1__Norovirus_and/or_Norovirus-like__KM268097
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3321 - protein, 538 aa, Artificial Sequence
  VP1__Norovirus_and/or_Norovirus-like__KM268084
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLARPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTKTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3322 - protein, 538 aa, Artificial Sequence
  VP1__Norovirus_and/or_Norovirus-like__KJ649704
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFSPKLGRIQFETDTNHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3323 - protein, 538 aa, Artificial Sequence
  VP1__Norovirus_and/or_Norovirus-like__KC577174
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSSNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGATTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3324 - protein, 538 aa, Artificial Sequence
  VP1__Norovirus_and/or_Norovirus-like__KF177451
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDNDFEANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3325 - protein, 538 aa, Artificial Sequence
  VP1__Norovirus_and/or_Norovirus-like__KF177429
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHSGQHDLVIPPNGYFRFDSWVNQFYTLAPMGNGTGRRR

SEQ ID NO: 3326 - protein, 538 aa, Artificial Sequence
  VP1__Norovirus_and/or_Norovirus-like__KF060005
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFTPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3327 - protein, 538 aa, Artificial Sequence
  VP1__Norovirus_and/or_Norovirus-like__JX439821
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISSSRNYTMNLASQNWSSYDPTEEIPAPLGTPDFVGKIQGVLTQTTRTDGSTRGHKATVYTGSADFSPKLGRVQFDTDTDNDFETNQNTKFTPVGVIQDGSTTYRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3328 - protein, 538 aa, Artificial Sequence
  VP1__Norovirus_and/or_Norovirus-like__KC517361
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDITHITGSRNYTMNLASQNWNNYDPTEEIPAPLGTPDFVGKIQGVLTQTTRTDGSTRGHKATVHTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3329 - protein, 538 aa, Artificial Sequence
  VP1__Norovirus_and/or_Norovirus-like__KC175378
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMSLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3330 - protein, 538 aa, Artificial Sequence
  VP1__Norovirus_and/or_Norovirus-like__JX459648
MKMASNDANPSEGSAANLVPEVNNEVMALEPVVGAAIAAPVAGQQNVIDPWIRNNFVQAPGGEFTVSPRNAPGTIRWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFSIPLEKLFTGPSGAFVVQPQNGRCTTDGVLLGTTQLSPVNICTFRGDVTHIAGSRNYTMNLAALNWNNYDPTEEIPAPLGTPDFVGKIQGVLTQTTKGDGSTRGHKATVYTGSADFTPKLGSVQFSTDTENDFESHQNTKFTPVGVIQDGSTTHRNEPQQWVLPSYSGRNVHNVHLAPAVAPTFPGEQLLFFRSTMPGCSGYPNMDLDCLIPQEWVQHFYQEAAPAQSDVALLRFVNPDTGRVLFECKLHKSGYVTVAHTGQHDLVIPPNGYFRFDSWVNQFYTLAPMGNGAGRRR

SEQ ID NO: 3331 - protein, 538 aa, Artificial Sequence
  VP1__Norovirus_and/or_Norovirus-like__JX459635
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIILDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTRRNEPQQWVLPSYSGRNAHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3332 - protein, 538 aa, Artificial Sequence
  VP1__Norovirus_and/or_Norovirus-like__JX459624
MKMASNDAHPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGPPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3333 - protein, 538 aa, Artificial Sequence
  VP1__Norovirus_and/or_Norovirus-like__JX459614
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQYDVALLRFVNPDTGRVLFECKLHKSGYVTVAHTGQHDLVIPPNGYFRFDSWVNQFYTLAPMGNGTGRRR

SEQ ID NO: 3334 - protein, 538 aa, Artificial Sequence
  VP1__Norovirus_and/or_Norovirus-like__HM635103
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDLETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3335 - protein, 538 aa, Artificial Sequence
  VP1__Norovirus_and/or_Norovirus-like__JQ613522
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEEIPAPLGTPDFVGKIQGMLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3336 - protein, 538 aa, Artificial Sequence
  VP1__Norovirus_and/or_Norovirus-like__AB629942
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTQNDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSRYVTVAHTGQHDLVIPPNGYFRFDSWVNQFYTLAPMGNGTGRRR

SEQ ID NO: 3337 - protein, 538 aa, Artificial Sequence
  VP1__Norovirus_and/or_Norovirus-like__GQ856457
MKMASNDANPSDGPAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSSNYTMNLASLNWNNYDPTEEIPAPLGTPDFVGKIQGVLTQTTKGDGSTRGHKATVYTGSAPFTPKLGSVQFSTDTQNDFETHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSRYVTVAHTGQHDLVIPPNGYFRFDSWVNQFYTLAPMGNGTGRRR

SEQ ID NO: 3338 - protein, 538 aa, Artificial Sequence
  VP1__Norovirus_and/or_Norovirus-like__EU876883
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMSPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGGTTHQNEPQQWVLPNYSGRDGHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3339 - protein, 538 aa, Artificial Sequence
  VP1__Norovirus_and/or_Norovirus-like__AB447455
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLSWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3340 - protein, 538 aa, Artificial Sequence
  VP1__Norovirus_and/or_Norovirus-like__EU078409
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3341 - protein, 538 aa, Artificial Sequence
  VP1__Norovirus_and/or_Norovirus-like__AB303928
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTLRGDVTHIAGTHNYTMNLASQNWNNYDPTEEIPAPLGTPDFVGRIQGVLTQTTRGDGSTRGHKATVSTGDVHFTPKLGSVQFNTDTNNDFEIGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3342 - protein, 538 aa, Artificial Sequence
  VP1__Norovirus_and/or_Norovirus-like__AY502023
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3343 - protein, 538 aa, Artificial Sequence
  VP1__Norovirus_and/or_Norovirus-like__KU678202
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGMLTQTTRTDGSTRGHKATVYTGSADFAPKLGRVQFETDTNNDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3344 - protein, 538 aa, Artificial Sequence
  VP1__Norovirus_and/or_Norovirus-like__KX371607
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3345 - protein, 538 aa, Artificial Sequence
  VP1__Norovirus_and/or_Norovirus-like__KX354112
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHIGQHDLVIPPNGYFRFDSWVNQFYTLAPMGNGTGRRR

SEQ ID NO: 3346 - protein, 538 aa, Artificial Sequence
  VP1__Norovirus_and/or_Norovirus-like__KX353993
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGATTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3347 - protein, 538 aa, Artificial Sequence
  VP1__Norovirus_and/or_Norovirus-like__KR131762
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3348 - protein, 538 aa, Artificial Sequence
  VP1__Norovirus_and/or_Norovirus-like__AB972519
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3349 - protein, 538 aa, Artificial Sequence
  VP1__Norovirus_and/or_Norovirus-like__AB972498
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMELDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3350 - protein, 538 aa, Artificial Sequence
  VP1__Norovirus_and/or_Norovirus-like__AB972488
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFVPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3351 - protein, 538 aa, Artificial Sequence
  VP1__Norovirus_and/or_Norovirus-like__AB972483
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3352 - protein, 538 aa, Artificial Sequence
  VP1__Norovirus_and/or_Norovirus-like__KP864106
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3353 - protein, 538 aa, Artificial Sequence
  VP1__Norovirus_and/or_Norovirus-like__KR904216
MKMASSDANPSDGSTANLAPEVNNEVMALEPVVGAAIAAPVAGQKNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSAPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQRDLVIPPNGYFRFDSWVNQFYSLAPMGNGTGRRR

SEQ ID NO: 3354 - protein, 538 aa, Artificial Sequence
  VP1__Norovirus_and/or_Norovirus-like__AB933771
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNSYDPTEEIPAPLGTPDFVGKIQGVLTQTTRTNGSTRGHKATVYTGSADFSPKLGRVQFATDTDNDFEANQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3355 - protein, 538 aa, Artificial Sequence
  VP1__Norovirus_and/or_Norovirus-like__LC005732
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRR

SEQ ID NO: 3356 - protein, 538 aa, Artificial Sequence
  VP1__Norovirus_and/or_Norovirus-like__KP293591
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRADGSTRGHKATVYTGSANFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3357 - protein, 538 aa, Artificial Sequence
  VP1__Norovirus_and/or_Norovirus-like__KP176396
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTIESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3358 - protein, 538 aa, Artificial Sequence
  VP1__Norovirus_and/or_Norovirus-like__KP176394
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPAEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3359 - protein, 538 aa, Artificial Sequence
  VP1__Norovirus_and/or_Norovirus-like__KP096348
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFDANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3360 - protein, 538 aa, Artificial Sequence
  VP1__Norovirus_and/or_Norovirus-like__KP096344
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSSYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3361 - protein, 538 aa, Artificial Sequence
  VP1__Norovirus_and/or_Norovirus-like__KM982946
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFETNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3362 - protein, 538 aa, Artificial Sequence
  VP1__Norovirus_and/or_Norovirus-like__KM514070
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHVTGSRNYTMNLASQNWSNYDPTEEIPAPLGTPDFVGKIQGVLTQTTRTDGSTRGHKATVYTGSANFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3363 - protein, 538 aa, Artificial Sequence
  VP1__Norovirus_and/or_Norovirus-like__KM514061
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQIILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3364 - protein, 538 aa, Artificial Sequence
  VP1__Norovirus_and/or_Norovirus-like__KM514060
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFSPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3365 - protein, 538 aa, Artificial Sequence
  VP1__Norovirus_and/or_Norovirus-like__KM268079
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3366 - protein, 538 aa, Artificial Sequence
  VP1__Norovirus_and/or_Norovirus-like__KJ710247
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTIEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPIGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3367 - protein, 538 aa, Artificial Sequence
  VP1__Norovirus_and/or_Norovirus-like__KJ685405
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQTILAGNAFTAGKIIFAAVPPNFPTEGLSPSQVTMFPHIIVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3368 - protein, 538 aa, Artificial Sequence
  VP1__Norovirus_and/or_Norovirus-like__KF429766
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVINQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3369 - protein, 538 aa, Artificial Sequence
  VP1__Norovirus_and/or_Norovirus-like__KF060009
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFDANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3370 - protein, 538 aa, Artificial Sequence
  VP1__Norovirus_and/or_Norovirus-like__KF059996
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3371 - protein, 538 aa, Artificial Sequence
  VP1__Norovirus_and/or_Norovirus-like__HF952130
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3372 - protein, 538 aa, Artificial Sequence
  VP1__Norovirus_and/or_Norovirus-like__KC409302
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFEINQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3373 - protein, 538 aa, Artificial Sequence
  VP1__Norovirus_and/or_Norovirus-like__JX459908
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNDYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3374 - protein, 538 aa, Artificial Sequence
  VP1__Norovirus_and/or_Norovirus-like__JX445166
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3375 - protein, 538 aa, Artificial Sequence
  VP1__Norovirus_and/or_Norovirus-like__HQ693090
MKMASNDANPSDGSAANLVPEVNNEVMALEPVVGAAIAAPVAGQQNVIDPWIRNNFVQAPGGEFAVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFAPVGVIQDGSTTHRNEPQQWVLPSYSGGNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3376 - protein, 538 aa, Artificial Sequence
  VP1__Norovirus_and/or_Norovirus-like__JN400611
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDLIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3377 - protein, 538 aa, Artificial Sequence
  VP1__Norovirus_and/or_Norovirus-like__JN400609
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLGPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGGAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3378 - protein, 538 aa, Artificial Sequence
  VP1__Norovirus_and/or_Norovirus-like__JQ613517
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLDPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRGDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3379 - protein, 538 aa, Artificial Sequence
  VP1__Norovirus_and/or_Norovirus-like__JQ478409
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGGRR

SEQ ID NO: 3380 - protein, 538 aa, Artificial Sequence
  VP1__Norovirus_and/or_Norovirus-like__GQ856460
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTDPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCPLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3381 - protein, 538 aa, Artificial Sequence
  VP1__Norovirus_and/or_Norovirus-like__GQ856449
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGTHNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGGNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYSRFDPWVNQFYTLAPMGNGTGRRR

SEQ ID NO: 3382 - protein, 538 aa, Artificial Sequence
  VP1__Norovirus_and/or_Norovirus-like__EU921344
MKMASSDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQNYTMNLASQNWNNYDPTEEIPAPLGTPDFVGKIQGMPTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3383 - protein, 538 aa, Artificial Sequence
  VP1__Norovirus_and/or_Norovirus-like__AB541290
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3384 - protein, 538 aa, Artificial Sequence
  VP1__Norovirus_and/or_Norovirus-like__GQ845322
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3385 - protein, 538 aa, Artificial Sequence
  VP1__Norovirus_and/or_Norovirus-like__AB220921
MKMASNDASPSDGSTANLVPEVNNEVMALEPVVGAAIAAPVAGQQNVIDPWIRTNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVIHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3386 - protein, 538 aa, Artificial Sequence
  VP1__Norovirus_and/or_Norovirus-like__KX514221
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPVNLERLFTGPSSANVVQPQNGRCTIDGELLGTTQLSSVNICTFRGDVTHIGSTHHWTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPQRSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3387 - protein, 538 aa, Artificial Sequence
  VP1__Norovirus_and/or_Norovirus-like__KY486271
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3388 - protein, 538 aa, Artificial Sequence
  VP1__Norovirus_and/or_Norovirus-like__KP784692
MKMASSDANPSDGSTANLVPEVNNEVMALEPVVGAALAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIIVDVRQLEPVLIPLPDVRNNFYHYNQSNESTIKLIAMLYTPLRANNAGDDVFTVSCRVLTRPSPDFDFIFLVPPTVESRTKPFSVPILTVEEMTNSRFPIPLERLFTGPSSAFVVQPQNGRCTTDGVLLGTTQLSPVNICTFRGDVTHTTGSHNYTMNLASQNWSNYDPTEEIPAPLGTPDFVGKIQGVLTQTTRADGSTRGHKATVYTGSADFTPKLGRVQFATDTDHDFDTNQNTKFTPVGVIQDGSTTHRNEPQQWVLPSYSGRNTHNVHLAPAVAPTFPGEQLLFFRSTMPGCSGYPNMDLDCLLPQEWVAHFYQEAAPAQSDVALLRFVNPDTGRVLFECKLHKSGYVTVAHTGQHDLVIPPNGYFRFDSWVNQFYTLAPMGNGTGRRR

SEQ ID NO: 3389 - protein, 538 aa, Artificial Sequence
  VP1__Norovirus_and/or_Norovirus-like__KX371604
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAIAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3390 - protein, 538 aa, Artificial Sequence
  VP1__Norovirus_and/or_Norovirus-like__KX354079
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEVPAPLGTPDFVGKIQGVLTQTTRTDGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGSGTGRRR

SEQ ID NO: 3391 - protein, 538 aa, Artificial Sequence
  VP1__Norovirus_and/or_Norovirus-like__KX354028
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3392 - protein, 538 aa, Artificial Sequence
  VP1__Norovirus_and/or_Norovirus-like__KX353983
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIVFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3393 - protein, 538 aa, Artificial Sequence
  VP1__Norovirus_and/or_Norovirus-like__AB972511
MKMASNDANPSDGPAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSIMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3394 - protein, 538 aa, Artificial Sequence
  VP1__Norovirus_and/or_Norovirus-like__AB972478
MKMASSDANPTDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3395 - protein, 538 aa, Artificial Sequence
  VP1__Norovirus_and/or_Norovirus-like__KT780382
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3396 - protein, 538 aa, Artificial Sequence
  VP1__Norovirus_and/or_Norovirus-like__KT033905
MKMASNDANPSDGSAANLVPKVNNEVMALEPVVGAAIAAPVAGQQNVIDPWIRNNFVQAPGGKFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3397 - protein, 538 aa, Artificial Sequence
  VP1__Norovirus_and/or_Norovirus-like__KR904207
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSTFVVQPQNGRCTTDGVLLGTTQLSPVNICTFRGDVTHIAGSHNYTMNLASQNWNSYDPTEEIPAPLGTPDFVGKIQGVLTQTTRTDGSTRGHKATVYTGSADSSPKLGRVQFATDTDNDFVANQNTKFTPVGVIQDGGTAHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTQAHTGQHDLVIPPNGYFRFDSWVNQFYTLAPMGNGTGRRR

SEQ ID NO: 3398 - protein, 538 aa, Artificial Sequence
  VP1__Norovirus_and/or_Norovirus-like__KJ678151
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3399 - protein, 538 aa, Artificial Sequence
  VP1__Norovirus_and/or_Norovirus-like__KJ678143
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3400 - protein, 538 aa, Artificial Sequence
  VP1__Norovirus_and/or_Norovirus-like__KP698927
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFGTNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3401 - protein, 538 aa, Artificial Sequence
  VP1__Norovirus_and/or_Norovirus-like__LC005730
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3402 - protein, 538 aa, Artificial Sequence
  VP1__Norovirus_and/or_Norovirus-like__LC005714
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSTPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3403 - protein, 538 aa, Artificial Sequence
  VP1__Norovirus_and/or_Norovirus-like__KP241906
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSANFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3404 - protein, 538 aa, Artificial Sequence
  VP1__Norovirus_and/or_Norovirus-like__KM982938
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGLLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3405 - protein, 538 aa, Artificial Sequence
  VP1__Norovirus_and/or_Norovirus-like__KM514058
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGLLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3406 - protein, 538 aa, Artificial Sequence
  VP1__Norovirus_and/or_Norovirus-like__KM198580
MKMASNDANPTDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3407 - protein, 538 aa, Artificial Sequence
  VP1__Norovirus_and/or_Norovirus-like__KM198537
MKMAPNDANPSDGSAANLVPEVSNEVMALEPVVGAAIAAPVAGQQNVIDPWIRNNFVQAPGGEFTVSPRNAPGEILWGAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHNGQHDLVIPPNGYFRFDSWVNQFYTLAPMGNGTGRRR

SEQ ID NO: 3408 - protein, 538 aa, Artificial Sequence
  VP1__Norovirus_and/or_Norovirus-like__KF177450
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLIPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3409 - protein, 538 aa, Artificial Sequence
  VP1__Norovirus_and/or_Norovirus-like__KF008243
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSTDFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3410 - protein, 538 aa, Artificial Sequence
  VP1__Norovirus_and/or_Norovirus-like__KF429782
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPLLIPLPDVRNNFYHYNQSNDPTIKLIAMLYTPLRANNAGDDVFTVSCRVLTRPSPDFDFIFLVPPTVESRTKPFSVPILTIEEMTNSRFPIPLEKLFTGPSSAFVVQPQNGRCTTDGVLLGTTQLSPVNICTFRGDVTHITGTHNYAMNLAAQNWNSYDPTEEIPAPLGTPDFVGKIQGVLTQTTRADGSTRAHKATVYTGSAEFAPKLGRVQFATDTDSDFDTNQNTKFTPVGVIQDGNTAHQNEPQQWVLPSYSGRNNHNVHLAPAVAPTFPGEQLLFFRSTMPGCSGYPNMNLDCLLPQEWVQYFYQEAAPAQSDVALLRFVNPDTGRVLFECKLHKSGYVTVAHTGQHDLVIPPNGYFRFDSWVSPFYTLAPMGNGTGRRR

SEQ ID NO: 3411 - protein, 538 aa, Artificial Sequence
  VP1__Norovirus_and/or_Norovirus-like__KF060101
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRADGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3412 - protein, 538 aa, Artificial Sequence
  VP1__Norovirus_and/or_Norovirus-like__KF060096
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSAVFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3413 - protein, 538 aa, Artificial Sequence
  VP1__Norovirus_and/or_Norovirus-like__KF060071
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLVSQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3414 - protein, 538 aa, Artificial Sequence
  VP1__Norovirus_and/or_Norovirus-like__KF060056
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRR

SEQ ID NO: 3415 - protein, 538 aa, Artificial Sequence
  VP1__Norovirus_and/or_Norovirus-like__JX439836
MKMASSDANPSDGSTANLVPEVNNEVMALEPVVGAAIAAPVAGQQNVIDPWIRNNFVQAPGGEFTVSPRNAPGEILWSASLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3416 - protein, 538 aa, Artificial Sequence
  VP1__Norovirus_and/or_Norovirus-like__HF952129
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3417 - protein, 538 aa, Artificial Sequence
  VP1__Norovirus_and/or_Norovirus-like__KC409273
MKMASNDANPSDGSAASLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRR

SEQ ID NO: 3418 - protein, 538 aa, Artificial Sequence
  VP1__Norovirus_and/or_Norovirus-like__KC409242
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3419 - protein, 538 aa, Artificial Sequence
  VP1__Norovirus_and/or_Norovirus-like__JX445167
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEVPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3420 - protein, 538 aa, Artificial Sequence
  VP1__Norovirus_and/or_Norovirus-like__JX445156
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLGANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQEYTMNLASQNWNNYDPTEEIPAPLGTPDFVGKIQGVLTQTTRRDGSTRGHKATVSTGSVHFTPKLGRIQFSTDTSNDFETGQNTRFTPVGVVQDGSTTHQNEPQQWVLPNYSGRDSHNVHLAPAVAPSFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3421 - protein, 538 aa, Artificial Sequence
  VP1__Norovirus_and/or_Norovirus-like__GQ856458
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNALTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVPTQTTKGDGSTRGHKATVYTGSAPFTPKLGSVQFSTDTENDFEAHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3422 - protein, 538 aa, Artificial Sequence
  VP1__Norovirus_and/or_Norovirus-like__AB541299
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEHSLYFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3423 - protein, 538 aa, Artificial Sequence
  VP1__Norovirus_and/or_Norovirus-like__AB541195
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGNVQFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3424 - protein, 538 aa, Artificial Sequence
  VP1__Norovirus_and/or_Norovirus-like__AB504322
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPGFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3425 - protein, 538 aa, Artificial Sequence
  VP1__Norovirus_and/or_Norovirus-like__EU876892
MKMASNDANPSDGSAANLVLEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3426 - protein, 538 aa, Artificial Sequence
  VP1__Norovirus_and/or_Norovirus-like__EU876891
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEKMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3427 - protein, 538 aa, Artificial Sequence
  VP1__Norovirus_and/or_Norovirus-like__AB294792
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFDVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSTHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3428 - protein, 538 aa, Artificial Sequence
  VP1__Norovirus_and/or_Norovirus-like__AB303932
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSVQFNTDTNNDFETGQNTRFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3429 - protein, 538 aa, Artificial Sequence
  VP1__Norovirus_and/or_Norovirus-like__LC177660
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKLGYVTVAHTGQHDLVIPPNGYFRFDSWVNQFYTLAPMGNGTGRRR

SEQ ID NO: 3430 - protein, 538 aa, Artificial Sequence
  VP1__Norovirus_and/or_Norovirus-like__KX608866
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3431 - protein, 538 aa, Artificial Sequence
  VP1__Norovirus_and/or_Norovirus-like__KX371603
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3432 - protein, 538 aa, Artificial Sequence
  VP1__Norovirus_and/or_Norovirus-like__KX354086
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNDDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3433 - protein, 538 aa, Artificial Sequence
  VP1__Norovirus_and/or_Norovirus-like__KX354080
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3434 - protein, 538 aa, Artificial Sequence
  VP1__Norovirus_and/or_Norovirus-like__KX354054
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3435 - protein, 538 aa, Artificial Sequence
  VP1__Norovirus_and/or_Norovirus-like__KX354041
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSLPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSVDFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3436 - protein, 538 aa, Artificial Sequence
  VP1__Norovirus_and/or_Norovirus-like__KX354029
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRR

SEQ ID NO: 3437 - protein, 538 aa, Artificial Sequence
  VP1__Norovirus_and/or_Norovirus-like__KX353977
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGGTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3438 - protein, 538 aa, Artificial Sequence
  VP1__Norovirus_and/or_Norovirus-like__KX353965
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3439 - protein, 538 aa, Artificial Sequence
  VP1__Norovirus_and/or_Norovirus-like__KU311158
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRADGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3440 - protein, 538 aa, Artificial Sequence
  VP1__Norovirus_and/or_Norovirus-like__AB974408
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTTPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFSTDTENDFETHQNTKFTPVGVIQDGNTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3441 - protein, 538 aa, Artificial Sequence
  VP1__Norovirus_and/or_Norovirus-like__KR904221
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGAPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3442 - protein, 538 aa, Artificial Sequence
  VP1__Norovirus_and/or_Norovirus-like__AB933765
MKMASSDANPSDGSTANLVPEVNNEVMALEPVVGAAIAAPVAGQQNVIDPWIRNNFVQAPGGEFTVSPRNAPGEILWSEPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3443 - protein, 538 aa, Artificial Sequence
  VP1__Norovirus_and/or_Norovirus-like__AB933761
MKMASSDANPSDGSTANLVPEVNNEVMALEPVVGAAIAAPVAGQQNVIDPWIRINFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3444 - protein, 538 aa, Artificial Sequence
  VP1__Norovirus_and/or_Norovirus-like__AB933748
MKMASSDANPSDGSTANLVPEVNNEVMALEPVVGAAIAAPVAGQQNVIDPWIRNNFVQAPGGEFTVSPRNAPGEILWSGTLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3445 - protein, 538 aa, Artificial Sequence
  VP1__Norovirus_and/or_Norovirus-like__EU921386
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVIHIAGSRNYTMNLASLNWNNYDPTEEIPAPLGTPDFVGKIQGVLTQTTKGDGSTRGHKATVYTGSAPFTPKLGSVQFSTDTENDFEAHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3446 - protein, 538 aa, Artificial Sequence
  VP1__Norovirus_and/or_Norovirus-like__KP244321
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWMLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3447 - protein, 538 aa, Artificial Sequence
  VP1__Norovirus_and/or_Norovirus-like__KP698923
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTPNVHLAPAAAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3448 - protein, 538 aa, Artificial Sequence
  VP1__Norovirus_and/or_Norovirus-like__KP241905
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSRNYTMNLASQNWSNYDPTEEIPAPLGIPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3449 - protein, 538 aa, Artificial Sequence
  VP1__Norovirus_and/or_Norovirus-like__KP176393
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPSMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3450 - protein, 538 aa, Artificial Sequence
  VP1__Norovirus_and/or_Norovirus-like__KP096330
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRR

SEQ ID NO: 3451 - protein, 538 aa, Artificial Sequence
  VP1__Norovirus_and/or_Norovirus-like__KM982953
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQTNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGIPDFVGKIQGMLTQTTRTDGSTRGHKATVYTGSVDFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3452 - protein, 538 aa, Artificial Sequence
  VP1__Norovirus_and/or_Norovirus-like__KM982936
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3453 - protein, 538 aa, Artificial Sequence
  VP1__Norovirus_and/or_Norovirus-like__KM514073
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVLLAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3454 - protein, 538 aa, Artificial Sequence
  VP1__Norovirus_and/or_Norovirus-like__KM268086
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLARPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3455 - protein, 538 aa, Artificial Sequence
  VP1__Norovirus_and/or_Norovirus-like__KM198552
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASINWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRR

SEQ ID NO: 3456 - protein, 538 aa, Artificial Sequence
  VP1__Norovirus_and/or_Norovirus-like__KJ716358
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGAVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSIMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3457 - protein, 538 aa, Artificial Sequence
  VP1__Norovirus_and/or_Norovirus-like__KJ649702
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3458 - protein, 538 aa, Artificial Sequence
  VP1__Norovirus_and/or_Norovirus-like__KF429778
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGGTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3459 - protein, 538 aa, Artificial Sequence
  VP1__Norovirus_and/or_Norovirus-like__KF060113
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRAKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3460 - protein, 538 aa, Artificial Sequence
  VP1__Norovirus_and/or_Norovirus-like__KF060106
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3461 - protein, 538 aa, Artificial Sequence
  VP1__Norovirus_and/or_Norovirus-like__KF060100
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGMLTQTTRTDGSTRGHKATVYTGSVDFSPKLGRVQFTTDTDNDFETNQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3462 - protein, 538 aa, Artificial Sequence
  VP1__Norovirus_and/or_Norovirus-like__KF060069
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3463 - protein, 538 aa, Artificial Sequence
  VP1__Norovirus_and/or_Norovirus-like__KF060055
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSYDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTKTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRR

SEQ ID NO: 3464 - protein, 538 aa, Artificial Sequence
  VP1__Norovirus_and/or_Norovirus-like__KF060028
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRADGSTRGHKATVYTGSADFSPKLGRVQFATDTDNDFVANQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3465 - protein, 538 aa, Artificial Sequence
  VP1__Norovirus_and/or_Norovirus-like__KF060022
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICAFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3466 - protein, 538 aa, Artificial Sequence
  VP1__Norovirus_and/or_Norovirus-like__KC517376
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLSTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3467 - protein, 538 aa, Artificial Sequence
  VP1__Norovirus_and/or_Norovirus-like__KC517374
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAHSDVALLRFVNPDTGRVLFECKLHKSGYVTVAHTGQHDLVIPPNGYFRFDSWVNQFYTLAPMGSGTGRRR

SEQ ID NO: 3468 - protein, 538 aa, Artificial Sequence
  VP1__Norovirus_and/or_Norovirus-like__KC409308
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWMLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3469 - protein, 538 aa, Artificial Sequence
  VP1__Norovirus_and/or_Norovirus-like__KC175393
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVSICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3470 - protein, 538 aa, Artificial Sequence
  VP1__Norovirus_and/or_Norovirus-like__JX459623
MKMASNDPNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3471 - protein, 538 aa, Artificial Sequence
  VP1__Norovirus_and/or_Norovirus-like__JQ798158
MKMASNDANPSDGSTANLVPEVNNEVMALEPVVGAAIAAPVAGQQNVIDPWIRNNFVQAPGGEFTVSPRNAPGEILWSAPLGPDLNPYLAHLARMYNGYAGGFEVQVILAGNAFTAGKIIFAAVPPNFPTEGLSPSQVTMFPHIVVDVRQLEPVLIPLPDVGNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGAHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3472 - protein, 538 aa, Artificial Sequence
  VP1__Norovirus_and/or_Norovirus-like__JQ613566
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPVPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3473 - protein, 538 aa, Artificial Sequence
  VP1__Norovirus_and/or_Norovirus-like__AB541287
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3474 - protein, 538 aa, Artificial Sequence
  VP1__Norovirus_and/or_Norovirus-like__AB504320
MKMASNDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALMRFVNPDTGRVLFECKLHKSGYVTVAHTGQHDLVIPPNGYFRFDSWVNQFYTLAPMGNGTGRRR

SEQ ID NO: 3475 - protein, 538 aa, Artificial Sequence
  VP1__Norovirus_and/or_Norovirus-like__KU683739
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3476 - protein, 538 aa, Artificial Sequence
  VP1__Norovirus_and/or_Norovirus-like__KX354146
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRLPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3477 - protein, 538 aa, Artificial Sequence
  VP1__Norovirus_and/or_Norovirus-like__KX354075
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNAHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3478 - protein, 538 aa, Artificial Sequence
  VP1__Norovirus_and/or_Norovirus-like__KX354072
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYKGYAGGFEVQVILAGNAFTAGKIIFAAVPPNFPTEGLSPSQVTMFPHIIVDVRQLEPVLIPLPDVRNNFYHYNQSNDSTIKLIAMLYTPPRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSADFTPKLGSVQFATDTENDFETHQNTRFTPVGVIQDGSTTHRNEPQQWVLPSYSGRNVHNVHLAPAVAPNFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3479 - protein, 538 aa, Artificial Sequence
  VP1__Norovirus_and/or_Norovirus-like__KX354060
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3480 - protein, 538 aa, Artificial Sequence
  VP1__Norovirus_and/or_Norovirus-like__KX353959
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSATPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3481 - protein, 538 aa, Artificial Sequence
  VP1__Norovirus_and/or_Norovirus-like__KX353954
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRSIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3482 - protein, 538 aa, Artificial Sequence
  VP1__Norovirus_and/or_Norovirus-like__AB972529
MKMASSDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3483 - protein, 538 aa, Artificial Sequence
  VP1__Norovirus_and/or_Norovirus-like__AB972504
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3484 - protein, 538 aa, Artificial Sequence
  VP1__Norovirus_and/or_Norovirus-like__AB972503
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEETPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3485 - protein, 538 aa, Artificial Sequence
  VP1__Norovirus_and/or_Norovirus-like__KP244322
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNARDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFETNQNTKFTPVGVIQDGGTTHRNEPQQWVLPNYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3486 - protein, 538 aa, Artificial Sequence
  VP1__Norovirus_and/or_Norovirus-like__LC018706
MKMASSDANPSDGSAANLVPEVNNEDMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSANFSPKLGRVQFETDTDHDFEVNQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3487 - protein, 538 aa, Artificial Sequence
  VP1__Norovirus_and/or_Norovirus-like__KP096345
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWGNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3488 - protein, 538 aa, Artificial Sequence
  VP1__Norovirus_and/or_Norovirus-like__KM982939
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRR

SEQ ID NO: 3489 - protein, 538 aa, Artificial Sequence
  VP1__Norovirus_and/or_Norovirus-like__KM198588
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWALPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3490 - protein, 538 aa, Artificial Sequence
  VP1__Norovirus_and/or_Norovirus-like__KM198544
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHLIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3491 - protein, 538 aa, Artificial Sequence
  VP1__Norovirus_and/or_Norovirus-like__KM198522
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVRVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3492 - protein, 538 aa, Artificial Sequence
  VP1__Norovirus_and/or_Norovirus-like__KM198508
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDAALLRFVNPDTGRVLFECKLHKSGYVTVAHTGQHDLVIPPNGYFRFDSWVNQFYTLAPMGNGTGRRR

SEQ ID NO: 3493 - protein, 538 aa, Artificial Sequence
  VP1__Norovirus_and/or_Norovirus-like__KJ716367
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGIVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3494 - protein, 538 aa, Artificial Sequence
  VP1__Norovirus_and/or_Norovirus-like__KF177440
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPSMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3495 - protein, 538 aa, Artificial Sequence
  VP1__Norovirus_and/or_Norovirus-like__KF060117
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3496 - protein, 538 aa, Artificial Sequence
  VP1__Norovirus_and/or_Norovirus-like__KF060104
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPSFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3497 - protein, 538 aa, Artificial Sequence
  VP1__Norovirus_and/or_Norovirus-like__KF060095
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSGAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDSDFVTNQNTKFTPVGVIQDGSTTPRNEPQQWVLPSYSGRSTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3498 - protein, 538 aa, Artificial Sequence
  VP1__Norovirus_and/or_Norovirus-like__KF060084
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3499 - protein, 538 aa, Artificial Sequence
  VP1__Norovirus_and/or_Norovirus-like__KF060082
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQYDLVIPPNGYFRFDSWVNQFYTLAPMGNGTGRRR

SEQ ID NO: 3500 - protein, 538 aa, Artificial Sequence
  VP1__Norovirus_and/or_Norovirus-like__KF060079
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWSSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3501 - protein, 538 aa, Artificial Sequence
  VP1__Norovirus_and/or_Norovirus-like__KF060058
MKMASSDANPSDGSTANLVPEVNNEVMALEPVVGAAIAAPVAGQQNVIDPWIRNNFVQAPGGEFTVSPRNAPSTILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3502 - protein, 538 aa, Artificial Sequence
  VP1__Norovirus_and/or_Norovirus-like__KF060039
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3503 - protein, 538 aa, Artificial Sequence
  VP1__Norovirus_and/or_Norovirus-like__KF060030
MKMASSDANPSDGSAANLVPEVNNEVMALEPVVGAAIAAPVAGQQNVIDPWIRNNFVQAPGGEFTVSPRNAPGEILWNAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYATVAHTGQHDLVIPPNGYFRFDSWVNQFYTLAPMGNGTGRRR

SEQ ID NO: 3504 - protein, 538 aa, Artificial Sequence
  VP1__Norovirus_and/or_Norovirus-like__JX439829
MKMGSNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3505 - protein, 538 aa, Artificial Sequence
  VP1__Norovirus_and/or_Norovirus-like__KC409282
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3506 - protein, 538 aa, Artificial Sequence
  VP1__Norovirus_and/or_Norovirus-like__KC409259
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPPNGYFRFDSWVNQFYTLAPMGNGTGRRR

SEQ ID NO: 3507 - protein, 538 aa, Artificial Sequence
  VP1__Norovirus_and/or_Norovirus-like__JX459659
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3508 - protein, 538 aa, Artificial Sequence
  VP1__Norovirus_and/or_Norovirus-like__JX459658
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFIVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3509 - protein, 538 aa, Artificial Sequence
  VP1__Norovirus_and/or_Norovirus-like__JX459595
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIPMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGTQSYTMNLASQNWNNYDPTEEIPAPLGTPDFVGKIQGVLTQTTRGDGSTRGHKATVSTGSVHFTPKLGSVQFSTDTSNDFETGQNTRFTPVGVVQDGSTTHQNEPQQWVLPNYSGRDSHNVHLAPAVAPTFPGEQLLFFRSTMPGCSGYPNMNLDCLLPQEWVQHFYQESAPAQSDVALLRFVNPDTGRVLFECKLHKSGYVTVAHTGQHDLVIPPNGYFRFDSWVNQFYTLAPMGNGAGRRR

SEQ ID NO: 3510 - protein, 538 aa, Artificial Sequence
  VP1__Norovirus_and/or_Norovirus-like__JQ613560
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3511 - protein, 538 aa, Artificial Sequence
  VP1__Norovirus_and/or_Norovirus-like__JQ613545
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNNYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3512 - protein, 538 aa, Artificial Sequence
  VP1__Norovirus_and/or_Norovirus-like__AB541288
MKMASNDANPSDGSAANLVPEVNNEVMALEPVVGAAIAAPVAGQQNVIDPWIRNNFVQAPGGEFTVSPRNAPGEIPWSAPLGPDLNPYLSHLARMYNGYAGGFEVQVVLAGNAFTAGKVIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSTPFTPKLGSVQFSTDTENDFENHQNTKFTPVGVIQDGGTTHRNEPQQWVLPSYSGRNVQNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3513 - protein, 538 aa, Artificial Sequence
  VP1__Norovirus_and/or_Norovirus-like__AB541247
MKMASNDANRSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRSEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3514 - protein, 538 aa, Artificial Sequence
  VP1__Norovirus_and/or_Norovirus-like__EU839585
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLPQTTKGDGSTRGHKATVSTGSVDFTPKLGSVQFATDTDNDFETGQNTRFTPVGVIQDGSSTHRNEPQQWVLPDYSGRTVYNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3515 - protein, 538 aa, Artificial Sequence
  VP1__Norovirus_and/or_Norovirus-like__AY588021
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTRFTPVGVVQDGNGTHQNEPQQWVLPSYSGRTGHNVHLAPAVAPTFPGEQLLFFRSTTPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3516 - protein, 538 aa, Artificial Sequence
  VP1__Norovirus_and/or_Norovirus-like__KX514188
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLDKLFTGPSSANVVQPQNGRCTIDGELLGTTQLSPVNICTFRGDVTHPRDSQIYTMNLASPNWNNYDPTEEIPAPLGTPDFVGKIQGMLTQTTKGEGSTRGHRATVYVGSANYAPKLGRVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3517 - protein, 538 aa, Artificial Sequence
  VP1__Norovirus_and/or_Norovirus-like__KX354101
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3518 - protein, 538 aa, Artificial Sequence
  VP1__Norovirus_and/or_Norovirus-like__KX354023
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPPVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3519 - protein, 538 aa, Artificial Sequence
  VP1__Norovirus_and/or_Norovirus-like__KX353979
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3520 - protein, 538 aa, Artificial Sequence
  VP1__Norovirus_and/or_Norovirus-like__AB972491
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3521 - protein, 538 aa, Artificial Sequence
  VP1__Norovirus_and/or_Norovirus-like__AB972469
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTLRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3522 - protein, 538 aa, Artificial Sequence
  VP1__Norovirus_and/or_Norovirus-like__LC101819
MKMASNDDNPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNKFYTLAPMGNGTGRRR

SEQ ID NO: 3523 - protein, 538 aa, Artificial Sequence
  VP1__Norovirus_and/or_Norovirus-like__KT202795
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGGTTHRNEPQQWVLPSYSGRNIPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3524 - protein, 538 aa, Artificial Sequence
  VP1__Norovirus_and/or_Norovirus-like__AB933742
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWINQFYTLAPMGNGTGRRR

SEQ ID NO: 3525 - protein, 538 aa, Artificial Sequence
  VP1__Norovirus_and/or_Norovirus-like__AB933722
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRAKPFTVPILTVEEMTNSRFPIPLEKLFTGPSSAFVVQPQNGRCTTDGVLLGTTQLSPVNICTFRGDVTHIAGSRNYTMNLASPNWNNYDPTEEIPAPLGTPDFVGKIQGMLTQTTKGDGSTRGHKATVYTGSAPFTPKLGSVQFSTDTENDFETHQNTKFTPVGVIQDGSTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3526 - protein, 538 aa, Artificial Sequence
  VP1__Norovirus_and/or_Norovirus-like__KJ678138
MKMASSDANPSDGSAASLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3527 - protein, 538 aa, Artificial Sequence
  VP1__Norovirus_and/or_Norovirus-like__KP244317
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIARLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFHTLAPMGNGTGRRR

SEQ ID NO: 3528 - protein, 538 aa, Artificial Sequence
  VP1__Norovirus_and/or_Norovirus-like__KP698925
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYLYQEAAPAQSDVALLRFVNPDTGRVLFECKLHKSGYVTVAHTGQHDLVIPPNGYFRFDSWVNQFYTLAPMGNGTGRRR

SEQ ID NO: 3529 - protein, 538 aa, Artificial Sequence
  VP1__Norovirus_and/or_Norovirus-like__LC005727
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRTDGSTRGHKATVYTGSADFAPKLGRVQFETDTNHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3530 - protein, 538 aa, Artificial Sequence
  VP1__Norovirus_and/or_Norovirus-like__LC016603
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHISGTSTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSGAHRNEPQQWVLPDYSGKTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3531 - protein, 538 aa, Artificial Sequence
  VP1__Norovirus_and/or_Norovirus-like__LC016599
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPSTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3532 - protein, 538 aa, Artificial Sequence
  VP1__Norovirus_and/or_Norovirus-like__KP293587
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLKPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSHSYTMNLASQNWSNYDPTEEIPAPLGTPDFVGKIQGVLTQTTRTDGSTRGHKATVYTGSADFAPKLGRVQFETDTNHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMRNGTGRRR

SEQ ID NO: 3533 - protein, 538 aa, Artificial Sequence
  VP1__Norovirus_and/or_Norovirus-like__KP176402
MKMASSDANPSDGSAANLVPEVNNEVMALEPVVGAAIAAPVAGQQNVIDPWIRNNLVQAPGGEFTVSPRNAPGEILWSAPLGPELNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3534 - protein, 538 aa, Artificial Sequence
  VP1__Norovirus_and/or_Norovirus-like__KJ196287
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGHAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3535 - protein, 538 aa, Artificial Sequence
  VP1__Norovirus_and/or_Norovirus-like__KM198480
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLYKSGYVTVAHTGQHDLVIPPNGYFRFDSWVNQFYTLAPMGNGTGRRR

SEQ ID NO: 3536 - protein, 538 aa, Artificial Sequence
  VP1__Norovirus_and/or_Norovirus-like__KJ716357
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGHAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3537 - protein, 538 aa, Artificial Sequence
  VP1__Norovirus_and/or_Norovirus-like__KJ716354
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYIGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3538 - protein, 538 aa, Artificial Sequence
  VP1__Norovirus_and/or_Norovirus-like__KJ685403
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFTTDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3539 - protein, 538 aa, Artificial Sequence
  VP1__Norovirus_and/or_Norovirus-like__KF060108
MKMASSDANPSDGSSANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKR

SEQ ID NO: 3540 - protein, 538 aa, Artificial Sequence
  VP1__Norovirus_and/or_Norovirus-like__KF060099
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3541 - protein, 538 aa, Artificial Sequence
  VP1__Norovirus_and/or_Norovirus-like__KF060004
MKMASSDANPSDGSVANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3542 - protein, 538 aa, Artificial Sequence
  VP1__Norovirus_and/or_Norovirus-like__KF060006
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRINGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3543 - protein, 538 aa, Artificial Sequence
  VP1__Norovirus_and/or_Norovirus-like__KC517371
MKMASNDANPSDGSAANLVPEVDNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLAPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3544 - protein, 538 aa, Artificial Sequence
  VP1__Norovirus_and/or_Norovirus-like__JX459657
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3545 - protein, 538 aa, Artificial Sequence
  VP1__Norovirus_and/or_Norovirus-like__JX459656
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3546 - protein, 538 aa, Artificial Sequence
  VP1__Norovirus_and/or_Norovirus-like__JX445152
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFEAGQNTKFTPDGVVQDGNGTHQNEPQQWVLPSYSGRTGHNVHLAPAIAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3547 - protein, 538 aa, Artificial Sequence
  VP1__Norovirus_and/or_Norovirus-like__JQ613553
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVQEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3548 - protein, 538 aa, Artificial Sequence
  VP1__Norovirus_and/or_Norovirus-like__JQ613521
MKMASNDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRDYTMNLASLNWNNYDPTEETPAPLGTPDFVGKIQGMLTQTTKGDGSTRGHKATVYTGSAPFTPKLGSVRFSTDTENDFETHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3549 - protein, 538 aa, Artificial Sequence
  VP1__Norovirus_and/or_Norovirus-like__HQ005298
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3550 - protein, 538 aa, Artificial Sequence
  VP1__Norovirus_and/or_Norovirus-like__HQ005296
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3551 - protein, 538 aa, Artificial Sequence
  VP1__Norovirus_and/or_Norovirus-like__HM802555
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3552 - protein, 538 aa, Artificial Sequence
  VP1__Norovirus_and/or_Norovirus-like__GQ246801
MKMASSDAHPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAYTGQHDLVIPPNGYFRFDSWVNQFYTLAPMGNGTGRRR

SEQ ID NO: 3553 - protein, 538 aa, Artificial Sequence
  VP1__Norovirus_and/or_Norovirus-like__AB504308
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTHGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3554 - protein, 538 aa, Artificial Sequence
  VP1__Norovirus_and/or_Norovirus-like__DQ369797
MKMAPNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVSICTFRGDVTHIPGTRIYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3555 - protein, 538 aa, Artificial Sequence
  VP1__Norovirus_and/or_Norovirus-like__LC177661
MKMASSDANPSDGSAANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSTDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3556 - protein, 538 aa, Artificial Sequence
  VP1__Norovirus_and/or_Norovirus-like__LC175468
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3557 - protein, 538 aa, Artificial Sequence
  VP1__Norovirus_and/or_Norovirus-like__KX354137
MKMASSDANPSDGSAANLVPEVSNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHITGSHNYTMNLASQNWNNYDPTEEIPAPLGTPDFVGKIQGVLTQTTRSDGSTRGHKATVYTGSADFAPKLGRVQFETDTDRDFETNQNTKFTPVGVIQDGTTAHRNEPQQWVLPSYSGRNIHNVHLAPAVAPTFPGEQLLSFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3558 - protein, 538 aa, Artificial Sequence
  VP1__Norovirus_and/or_Norovirus-like__KX354036
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGSPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3559 - protein, 538 aa, Artificial Sequence
  VP1__Norovirus_and/or_Norovirus-like__KX354011
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3560 - protein, 538 aa, Artificial Sequence
  VP1__Norovirus_and/or_Norovirus-like__LC153122
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLVSQNWNNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3561 - protein, 538 aa, Artificial Sequence
  VP1__Norovirus_and/or_Norovirus-like__KR131777
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWSSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3562 - protein, 538 aa, Artificial Sequence
  VP1__Norovirus_and/or_Norovirus-like__AB933764
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3563 - protein, 538 aa, Artificial Sequence
  VP1__Norovirus_and/or_Norovirus-like__LC016600
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTSTYRMNLASQNWNNYDPTEEIPAPLGTPDFVGKIQGMLTQTTKGDGSTRGHKATVSTGSVDFTPKLGSVQFATDTDNDFETGQNTRFTPVGVIQDGSGAHRNEPQQWVLPNYSGRTVHNVHLAPAVAPTFPGEQLLFFRSTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3564 - protein, 538 aa, Artificial Sequence
  VP1__Norovirus_and/or_Norovirus-like__KJ433970
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSRYVTVAHTGQHDLVIPPNGYFRFDSWVNQFYTLAPMGNGTGRRR

SEQ ID NO: 3565 - protein, 538 aa, Artificial Sequence
  VP1__Norovirus_and/or_Norovirus-like__KP176395
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSVDFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3566 - protein, 538 aa, Artificial Sequence
  VP1__Norovirus_and/or_Norovirus-like__KM982947
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIAVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3567 - protein, 538 aa, Artificial Sequence
  VP1__Norovirus_and/or_Norovirus-like__KJ685414
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSSDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3568 - protein, 538 aa, Artificial Sequence
  VP1__Norovirus_and/or_Norovirus-like__KF060093
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGNTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3569 - protein, 538 aa, Artificial Sequence
  VP1__Norovirus_and/or_Norovirus-like__KC456070
MKMASSDANPSDGSAANLVPKVNNEVMALEPVVGAAIAAPVAGQQNVIDPWIKNNFVQAPGGEFTVSPKNAPGEILWSAPLGPDLNPYLSHLAKMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTIGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3570 - protein, 538 aa, Artificial Sequence
  VP1__Norovirus_and/or_Norovirus-like__KC409299
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRDVHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3571 - protein, 538 aa, Artificial Sequence
  VP1__Norovirus_and/or_Norovirus-like__JX984947
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSSDFDFIFLVPPTVESRTKPFTVPILTVEEMTNSRFPIPLEKLFTGPSSAFVVQPQNGRCTTDGVLLGTTQLSPVNTCTFRGDVTHIAGSRNYTMNLASLNWNNYDPTEEIPAPLGTPDFVGKIQGVLTQTTKGDGSTRGHKATIYTGSAPFTPKLGSVQFNTDTENDFETHQNTKFTPVGVIQDGGTTHRNEPQQWVLPSYSGRNIPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3572 - protein, 538 aa, Artificial Sequence
  VP1__Norovirus_and/or_Norovirus-like__KC175385
MKMASSDANPSNGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPSSHNYTMNLASQNWNSYDPTEEIPAPLGTPDFVGKIQGVLTQTTRTDGSTRGHKATVYTGSADFSPKLGRVQFATDTDNDFQTNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3573 - protein, 538 aa, Artificial Sequence
  VP1__Norovirus_and/or_Norovirus-like__JQ613563
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHTPGSHNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3574 - protein, 538 aa, Artificial Sequence
  VP1__Norovirus_and/or_Norovirus-like__JQ613558
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHIGQYDLVIPPNGYFRFDSWVNQFYTLAPMGNGTGRRR

SEQ ID NO: 3575 - protein, 538 aa, Artificial Sequence
  VP1__Norovirus_and/or_Norovirus-like__GQ856451
MKMASNDANPSDGSVANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHMIVDVRQLEPVLIPLPDVRNNFYHYNQSNDSTIKLIAMLYTPLRADNAGEDVFTVSCRVLTRPSPDFDFIFLVPPTVESKTKPFTVPILTVEEMTNSRFPIPLEKLFTGPSSTFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYSRFDSWVNQFYTLAPMGNGTGRRR

SEQ ID NO: 3576 - protein, 538 aa, Artificial Sequence
  VP1__Norovirus_and/or_Norovirus-like__DQ419908
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTKGDGSTRGHKATVSTGSVDFTPKLDSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPSQSDVALLRFVNPDTGRVLFECKLHKAGYVTVAHTGQHDLVIPPNGYFRFDSWVNQFYTLAPMGNGAGRRR

SEQ ID NO: 3577 - protein, 538 aa, Artificial Sequence
  VP1__Norovirus_and/or_Norovirus-like__KX514354
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSTLVVQPQNGRCMIDGVLLGTTQLSPVNICTFRGDVTHSRDSTIYTMNLASPNWNNYDPTEEIPAPLGTPDFVGKIQGVLTQTTKGEGSTRGHRATVYVGSANYTPKLGKVQFETNTTNDLYAHQNTRFTPVGVVQGGESAHRSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3578 - protein, 538 aa, Artificial Sequence
  VP1__Norovirus_and/or_Norovirus-like__KX354062
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPNSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3579 - protein, 538 aa, Artificial Sequence
  VP1__Norovirus_and/or_Norovirus-like__AB972532
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3580 - protein, 538 aa, Artificial Sequence
  VP1__Norovirus_and/or_Norovirus-like__KT202796
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQDAAPAQSDVALLRFVNPDTGRVLFECKLHKSGYVTVAHTGQHDLVIPPNGYFRFDSWVNQFYTLAPMGNGTGRRR

SEQ ID NO: 3581 - protein, 538 aa, Artificial Sequence
  VP1__Norovirus_and/or_Norovirus-like__AB933751
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFENNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3582 - protein, 538 aa, Artificial Sequence
  VP1__Norovirus_and/or_Norovirus-like__KM514078
MKMASSDANPSDGSAANLVPEVNNEVLALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3583 - protein, 538 aa, Artificial Sequence
  VP1__Norovirus_and/or_Norovirus-like__KM198569
MKMASNDANPSDGSAANLVPEVSNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQTNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3584 - protein, 538 aa, Artificial Sequence
  VP1__Norovirus_and/or_Norovirus-like__KF768522
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3585 - protein, 538 aa, Artificial Sequence
  VP1__Norovirus_and/or_Norovirus-like__KF060120
MKMASSDANPSDGSTANLVPEVNNEVMALEPVVGAAIAAPVAGQQNVIDPWIRNNFVQAPGGEFTVSPRNAPGEILWNAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGKCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3586 - protein, 538 aa, Artificial Sequence
  VP1__Norovirus_and/or_Norovirus-like__KF060102
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGNVTHITGSRNYTMNLASQNWNNYDPTEEIPAPLGTPDFVGKIQGVLTQTTRTDGSTRGHKATVYIGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3587 - protein, 538 aa, Artificial Sequence
  VP1__Norovirus_and/or_Norovirus-like__KF060088
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3588 - protein, 538 aa, Artificial Sequence
  VP1__Norovirus_and/or_Norovirus-like__KF060025
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVADQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3589 - protein, 538 aa, Artificial Sequence
  VP1__Norovirus_and/or_Norovirus-like__KC517378
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVGNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3590 - protein, 538 aa, Artificial Sequence
  VP1__Norovirus_and/or_Norovirus-like__JX459640
MKMASSDANPSDGSTAHLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3591 - protein, 538 aa, Artificial Sequence
  VP1__Norovirus_and/or_Norovirus-like__JQ613512
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDAWVNQFYTLAPMGNGTGRKR

SEQ ID NO: 3592 - protein, 538 aa, Artificial Sequence
  VP1__Norovirus_and/or_Norovirus-like__HQ005299
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3593 - protein, 538 aa, Artificial Sequence
  VP1__Norovirus_and/or_Norovirus-like__AB541312
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDCILDLPPTVESRTKPFSVPILTVEEMTNSRFPIPLEKLFTGPSSAFVVQPQNGRCTTDGVLLGTTQLSPVNICTFRGDVTHITGSRNYTMNLATQNWNSYDPTEEIPAPLGTPDFVGKIQGVLTQTTRADGSTRGHKATVYTGSADFAPKLGRVQFATDTDNDFDANQNTKFTPVGVIQDGDTAHRNEPQQWVLPSYSGRNSHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3594 - protein, 538 aa, Artificial Sequence
  VP1__Norovirus_and/or_Norovirus-like__AB541275
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGSRSYTMNLASLNWNNYDPTEEIPAPLGTPDFVGKIQGMLTQTTKGDGSTRGHKATVYTGSAPFTPKLGSVQFSTDTENDFQTHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3595 - protein, 538 aa, Artificial Sequence
  VP1__Norovirus_and/or_Norovirus-like__AB303930
MKMASNDATPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNLYHYNQSNDPTIKLIAMLYTPLRANNAGEDVFTVSCRVLTRPSPDFDFIFLVPPTVESRTKPFTVPILTGEEMTNSRFPIPLEKLFTGPSGAFVVQPQNGRCTTDGVLLGTTQLLPVNICTFRGDVTHIAGTHNYTMNLASQNWNNYDPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTSHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3596 - protein, 538 aa, Artificial Sequence
  VP1__Norovirus_and/or_Norovirus-like__AY485642
MKMASNDANPSDGSTANLVPEVNNEVMALEPVVGAAIAAPVAGQQNVIDPWIRNNFVQAPGGEFTVSPRNAPGEILWSAPLGPDLNPYLPHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDVTHIAGTHNYTMNLASQNWNNYGPTEEIPAPLGTPDFVGRIQGMLTQTTRGDGSTRGHKATVSTGDVHFTPKLGSIQFNTDTNNDFETGQNTKFTPVGVVQDGNGTHQNEPQQWVLPSYSGRTGHNVHLAPAVAPTFPGEQLLFFRSTMPGCSGYPNMNLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3597 - protein, 538 aa, Artificial Sequence
  VP1__Norovirus_and/or_Norovirus-like__KX514343
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRTNNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQSGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQYDLVLPSNGYFRFDSWVNQFYTLAPMGNGTGRRR

SEQ ID NO: 3598 - protein, 538 aa, Artificial Sequence
  VP1__Norovirus_and/or_Norovirus-like__KX514274
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRSKPFSVPVLTVEEMTNSRFPVTLDKLFTGPSSTIVVQPQNGRCTIDGVLLGTTQLSPVNICTFRGDVTHPRDSTIYTMNLASPNWNTYDPTEEIPAPLGTPDFVGKIQGMLTQTTKGAGSTRGHRATVYVGSANYAPKLGRVQFETNTSDDLDAHQNTKFTPVGVIQGGESAHRSEPQQWVLPSYSGRDIPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3599 - protein, 538 aa, Artificial Sequence
  VP1__Norovirus_and/or_Norovirus-like__KX514175
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGANTFNVHLAPAVAPNFPGEQLLFFRSTLPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3600 - protein, 538 aa, Artificial Sequence
  VP1__Norovirus_and/or_Norovirus-like__KX354093
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWSSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3601 - protein, 538 aa, Artificial Sequence
  VP1__Norovirus_and/or_Norovirus-like__KX354003
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3602 - protein, 538 aa, Artificial Sequence
  VP1__Norovirus_and/or_Norovirus-like__KR131778
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTDQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3603 - protein, 538 aa, Artificial Sequence
  VP1__Norovirus_and/or_Norovirus-like__AB972468
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFVPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3604 - protein, 538 aa, Artificial Sequence
  VP1__Norovirus_and/or_Norovirus-like__KR904222
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNCDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3605 - protein, 538 aa, Artificial Sequence
  VP1__Norovirus_and/or_Norovirus-like__KP244320
MKMASSDANPSDGSTANLVPEVNNEVMALEPVVGASIAAPVAGQQNVIDPWIRNNFVQAPGGEFTVSPRNAPGEILWSAPLGPDLNPYLPHLARMYNGYAGGFEVQVILAGNAFTAGKIIFAAVPPNFPTEGLSPSQVTMFPHIIVDVRQLEPVLIPLPDVRNNFYHYYQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNESQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3606 - protein, 538 aa, Artificial Sequence
  VP1__Norovirus_and/or_Norovirus-like__KP244315
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFVVQVILAGNAFTAGKIIFAAVPPNFPTEGLSPSQVTMFPHIIVDARQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTKTDGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3607 - protein, 538 aa, Artificial Sequence
  VP1__Norovirus_and/or_Norovirus-like__KP244314
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYVGGFEVQVILAGNAFTAGKIIFAAVPPNFPTEGLSPSQVTMFPHIIVDVRQLEPVLIPLPDVRNNFHHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRIQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3608 - protein, 538 aa, Artificial Sequence
  VP1__Norovirus_and/or_Norovirus-like__KM268078
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3609 - protein, 538 aa, Artificial Sequence
  VP1__Norovirus_and/or_Norovirus-like__KM198555
MKMASSDANPSDGSTASLVPEVNNEVMALEPVVGAAIAAPVAGQQNVIDPWIRNNFVQAPGGEFTVSPRNAPGEILWSAPLGPDLNPYLSHLARMYNGYAGGFEVQVVLAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQSWNSYDPTEEIPAPLGSPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3610 - protein, 538 aa, Artificial Sequence
  VP1__Norovirus_and/or_Norovirus-like__KF060115
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3611 - protein, 538 aa, Artificial Sequence
  VP1__Norovirus_and/or_Norovirus-like__KF060018
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3612 - protein, 538 aa, Artificial Sequence
  VP1__Norovirus_and/or_Norovirus-like__KC517365
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLDTTQLSPVNICTFRGDVTHIAGSRNYTMNLASLNWNNYDPTEEIPAPLGTPDFVGKIQGMLTQTTKGDGSTRGHKATVYTGSAPFTPKLGSVQFETDTENDFETHQNTKFTPVGVIQDGGTTHRNEPQQWVLPSYSGRNVPNAHLAPAVAPTFPGEQLLFFRSTMPGCSGYPNMDLDCLLPQEWVQHFYQEAAPAQSDVALLRFVNPDTGRVLFECKLHKSGYVTAAHTGQHDLVIPPNGYFRFDSWVNQFYTLAPMGNGTGRRR

SEQ ID NO: 3613 - protein, 538 aa, Artificial Sequence
  VP1__Norovirus_and/or_Norovirus-like__KC517360
MKMASNDASPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGMLTQTAKGDGSTRGHKATVYTGSAPFTPKLGSVQFETDTENDFETHQNTKFTPVGVIQDGGTTHRNEPQQWVLPSYSGRNVPNVHLAPAVAPTFPGEQLLFFRSTMPGCSGCPDMDLDCLLPQEWVQHFYQEAAPAQSDVALLRFVNPDTGRVLFECKLHKSGYVTVAHTGQHDLIIPPNGYFRFDSWVNQFYTLAPMGNGTGRRR

SEQ ID NO: 3614 - protein, 538 aa, Artificial Sequence
  VP1__Norovirus_and/or_Norovirus-like__JX846928
MKMASSDASPSDGSTANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQLNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGNTTPRNEPQQWVLPSYSGRNIQNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3615 - protein, 538 aa, Artificial Sequence
  VP1__Norovirus_and/or_Norovirus-like__JX459904
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGMLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKTGYVTVAHTGQHDLVIPPNGYFRFDSWVNQFYTLAPMGNGTGRRR

SEQ ID NO: 3616 - protein, 538 aa, Artificial Sequence
  VP1__Norovirus_and/or_Norovirus-like__JX459649
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFSIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3617 - protein, 538 aa, Artificial Sequence
  VP1__Norovirus_and/or_Norovirus-like__JX459643
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVEFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3618 - protein, 538 aa, Artificial Sequence
  VP1__Norovirus_and/or_Norovirus-like__JX459602
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSLDFDFIFLVPPTVESRTKPFTVPILTVEEMTNSRFPIPLEKLFTGPSGAFVVQPQNGRCTTDGVLLGTTQLSPVNICTFRGDVTHIAGSRNYTMNLASLNWNNYDPTEETPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3619 - protein, 538 aa, Artificial Sequence
  VP1__Norovirus_and/or_Norovirus-like__LC177655
MKMASSDANPSDGSAANLVPEVNNEVMALEPVVGAAIAAPVAGQQNVIDPWIRNNFVQAPGGEFTVSPRNAPGEILWRAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTPQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3620 - protein, 538 aa, Artificial Sequence
  VP1__Norovirus_and/or_Norovirus-like__KP784698
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFTPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3621 - protein, 538 aa, Artificial Sequence
  VP1__Norovirus_and/or_Norovirus-like__KX354104
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3622 - protein, 538 aa, Artificial Sequence
  VP1__Norovirus_and/or_Norovirus-like__KR904211
MKMASSDANPSDGSTANLVPEVNNEVMALEPVVGAAIAAPVAGQQNAIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFDANQNTKFTPVGVIQDGGTTHRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3623 - protein, 538 aa, Artificial Sequence
  VP1__Norovirus_and/or_Norovirus-like__AB933743
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRSIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3624 - protein, 538 aa, Artificial Sequence
  VP1__Norovirus_and/or_Norovirus-like__LN854572
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3625 - protein, 538 aa, Artificial Sequence
  VP1__Norovirus_and/or_Norovirus-like__KP244319
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVSIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRANGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3626 - protein, 538 aa, Artificial Sequence
  VP1__Norovirus_and/or_Norovirus-like__KF768470
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVSICTFRGDVTHIPGSHNYTMNLASQNWNSYDPTEEIPAPLGTPDFVGKIQGVLTQTTRTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3627 - protein, 538 aa, Artificial Sequence
  VP1__Norovirus_and/or_Norovirus-like__KC456073
MKMASSDANPSDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3628 - protein, 538 aa, Artificial Sequence
  VP1__Norovirus_and/or_Norovirus-like__KC456072
MKMASSDANPSDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3629 - protein, 538 aa, Artificial Sequence
  VP1__Norovirus_and/or_Norovirus-like__JX459622
MKMASNDAHPSDGSAATLVPKVNNEVMALEPVVGAAIAAPVAGQQNVIDPWIRNNFVQAPGGEFTVSPRNAPGEILWSAPLGPDLNPYLSHLARMYNGYAGGFELHVLLAGNAFTAGKIIIAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICIFRGDVTHIAGSRNYTMNLAALNWNNYDPTEEIPAPLGTPDFVGKIQGVLTQTTKGDGSTRGHKATVYTGSADFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3630 - protein, 538 aa, Artificial Sequence
  VP1__Norovirus_and/or_Norovirus-like__KX514290
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPILTVGEMTNSRFPINLERLFTGPSSANVVQPQNGRCTIDGELLGTTQLSSVNICTFRGDVTHIGSTHHWTMNLASPNWNNYDPTEETPAPLGTPDFVGKIHGMLTQTTQENGSTRAHRATVYVGSADFTPKLGKVQFETDTTNDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3631 - protein, 538 aa, Artificial Sequence
  VP1__Norovirus_and/or_Norovirus-like__KP784695
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGNTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3632 - protein, 538 aa, Artificial Sequence
  VP1__Norovirus_and/or_Norovirus-like__KX608865
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIAGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3633 - protein, 538 aa, Artificial Sequence
  VP1__Norovirus_and/or_Norovirus-like__AB972500
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3634 - protein, 538 aa, Artificial Sequence
  VP1__Norovirus_and/or_Norovirus-like__KT033902
MKMASSDANPSDGSTANLIPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDIFTVSCRVLTRPSPDFDFIFLVPPTVESRTKPFSVPVLTVEEMTNSRFPIPLEKLFTGPSSALVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3635 - protein, 538 aa, Artificial Sequence
  VP1__Norovirus_and/or_Norovirus-like__KR904220
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILVGNAFTAGKIIFAAVPPNFPTEGLSPSQVTMFPHIIVDVRQLEPVLIPLPDVRNNFYHYNQSSDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSHNYTMNLASQNWNSYDPTEEIPAPLGTPDFVGKIQGVLTQTTRTDGSTRGHKATVYTGSTDFTPKLGRAQFATDTDNDFETNQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3636 - protein, 538 aa, Artificial Sequence
  VP1__Norovirus_and/or_Norovirus-like__LN854566
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVSHITGSRNYTMNLASQNWNNYDPTEEIPAPLGTPDFVGKIQGMLTQTTRADGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3637 - protein, 538 aa, Artificial Sequence
  VP1__Norovirus_and/or_Norovirus-like__KP244313
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQATRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3638 - protein, 538 aa, Artificial Sequence
  VP1__Norovirus_and/or_Norovirus-like__KP096342
MKMASSDANPSDGSAANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYTGSADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRKR

SEQ ID NO: 3639 - protein, 538 aa, Artificial Sequence
  VP1__Norovirus_and/or_Norovirus-like__KM514067
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTPNVHLAPAVAPTFPGEQLLFFRSTMPGCSGYPNMDLDCLLPPEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3640 - protein, 538 aa, Artificial Sequence
  VP1__Norovirus_and/or_Norovirus-like__KF060049
MKMASSDANPSDGSTANLVPEVNNEVMALEPVVGAAIAAPVAGQQNIIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3641 - protein, 538 aa, Artificial Sequence
  VP1__Norovirus_and/or_Norovirus-like__KF059998
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSANGSTRGHKATVYTGSADFSPKLGRVQFATDTNNDFETNQNTKFTPVGVIQDGNTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3642 - protein, 538 aa, Artificial Sequence
  VP1__Norovirus_and/or_Norovirus-like__JX439833
MKMASSDANPSDGSKANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGSRR

SEQ ID NO: 3643 - protein, 538 aa, Artificial Sequence
  VP1__Norovirus_and/or_Norovirus-like__JQ613548
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPAEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3644 - protein, 538 aa, Artificial Sequence
  VP1__Norovirus_and/or_Norovirus-like__JN595867
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3645 - protein, 538 aa, Artificial Sequence
  VP1__Norovirus_and/or_Norovirus-like__AB629944
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSSYVTVAHTGQHDLVIPPNGYFRFDSWVNQFYTLAPMGNGTGRRH

SEQ ID NO: 3646 - protein, 538 aa, Artificial Sequence
  VP1__Norovirus_and/or_Norovirus-like__AB541192
MKMASSDANPPDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSGAFVVQPQNGRCTTDGVLLGTTQLSPVNICTFRGDATHIAGSRSYTMNLASLNWNNYDPTEEIPAPLGTPDFVGKIQGMLTQTTKGDGSTRGHKATVYTGSAPFTPKLGSVQFSTDTENDFQTHQNTKFTPVGVIQDGSTTHRNEPQQWVLPSYSGRDVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3647 - protein, 538 aa, Artificial Sequence
  VP1__Norovirus_and/or_Norovirus-like__AB504314
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGRIQGMLTQTTKGDGSTRGHKATVSTGSVDFTPKLGSVQFATDTDNDFETGQNTRFTPVGVIQDGSSALRNEPQQWVLPDYSGRTVHNVHLAPAVALTFPGEQLLFFRSTMPGCSGYPNMDLDCLLPQEWVQHFYQEAAPSQSDVALLRFVNPDTGRVLFECKLHRAGYVTVAHTGQHDLVIPPNGYFRFDSWVNQFYTLAPMGNGAGRRR

SEQ ID NO: 3648 - protein, 538 aa, Artificial Sequence
  VP1__Norovirus_and/or_Norovirus-like__KX514350
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQSGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3649 - protein, 538 aa, Artificial Sequence
  VP1__Norovirus_and/or_Norovirus-like__KX514342
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQSGESPKGSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3650 - protein, 538 aa, Artificial Sequence
  VP1__Norovirus_and/or_Norovirus-like__KX514280
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSKDSTIKLIAMLYTPLRANNAGDDVFTVSCRVLTRPSPDFDFIFLVPPTVESRSKPFSVPVLTVEEMTNSRFPVTLDKLFTGPSSTIVVQPQNGRCTIDGVLLGTTQLSPVNICTFRGDVTHPRDSTIYTMNLASPNWNTYDPTEEIPAPLGTPDFVGKIQGMLTQTTKGAGSTRGHRATVYVGSANYAPKLGRVQFETNTSDDLDAHQNTKFTPVGVIQGGESAHRSEPQQWVLPSYSGRDIPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3651 - protein, 538 aa, Artificial Sequence
  VP1__Norovirus_and/or_Norovirus-like__LC177654
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3652 - protein, 538 aa, Artificial Sequence
  VP1__Norovirus_and/or_Norovirus-like__KX354026
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3653 - protein, 538 aa, Artificial Sequence
  VP1__Norovirus_and/or_Norovirus-like__KR904218
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPRIIVDVRQLEPVLIPLPDVRNNFYHYNQSNDPTIKLIAMLYTPLRANNAGDDVFTVSCRVLTRPSPDFDFIFLVPPTVESRTKPFSVPILTVEEMTNSRFPIPLEKLFTGPSSAFVVQPQNGRCSTDGVLLGTTQLSPVNICTFRGDVTHIAGSHNYTMNLASQNWSSYDPTEEIPAPLGTPDFVGKIQGVLTQTTRTDGSTRGHKATVYTGSADFSPKLGRVQFATDTNNDFESNQNTKFAPVGVIQDGGTAHRNEPQQWVLPSYSGRNIHNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3654 - protein, 538 aa, Artificial Sequence
  VP1__Norovirus_and/or_Norovirus-like__KJ678150
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3655 - protein, 538 aa, Artificial Sequence
  VP1__Norovirus_and/or_Norovirus-like__KJ678148
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTIPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3656 - protein, 538 aa, Artificial Sequence
  VP1__Norovirus_and/or_Norovirus-like__KP244316
MKMASSDANPSDGSTANLVPEVNNEVMALEPVVGAAIAAPVAGQQNVIDPWIRSNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKTQGVLTQTTKTNGSTRGHKATVYTGSADFSPKLGRVQFATDTDNDFETNQNTKFTPVGVIQDGSTTPRDEPQQWVLPSYSGRNTHNVHLAPAVAPTFPGEQLLFFRSTMPGCSGYPNMDLDRLLPQEWVQYFYQEPAPAQSDVALLRFVNPDTGRVLFECKLHKSGYVTVAHTGQHDLVIPPNGYFRFDSWVNQFYTLAPMGNGTGRRR

SEQ ID NO: 3657 - protein, 538 aa, Artificial Sequence
  VP1__Norovirus_and/or_Norovirus-like__KF060072
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFITNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKPGYVTVAHTGQHDLVIPPNGYFRFDSWVNQFYTLAPMGNGTGRRR

SEQ ID NO: 3658 - protein, 538 aa, Artificial Sequence
  VP1__Norovirus_and/or_Norovirus-like__JX439822
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGSRR

SEQ ID NO: 3659 - protein, 538 aa, Artificial Sequence
  VP1__Norovirus_and/or_Norovirus-like__KC463910
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFSTDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3660 - protein, 538 aa, Artificial Sequence
  VP1__Norovirus_and/or_Norovirus-like__JX459651
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFSIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3661 - protein, 538 aa, Artificial Sequence
  VP1__Norovirus_and/or_Norovirus-like__AB541314
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEVVFTVSCRVLTRPSPDFDFICLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKPGYVTVAHTGQHDLVIPSNGYFRFDSWVNQFYTLAPMGNGTGRRR

SEQ ID NO: 3662 - protein, 538 aa, Artificial Sequence
  VP1__Norovirus_and/or_Norovirus-like__AB504323
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIIDVRQLEPVLIPLPDVRNNFYHYNQSNDSTIKLIAMLYTPLRANNAGEDVFTVSCRVLTRPSLDFDFIFLVPPTVESRTKPFTVPILTVEEMTNSRFPIPLEKLFTGPSGAFVVQPQNGRCTTDGVLLGTTQLSPVNICTLRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGSTTHRNEPQQWVLPSYSGRNVHNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3663 - protein, 538 aa, Artificial Sequence
  VP1__Norovirus_and/or_Norovirus-like__KX353963
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQDTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3664 - protein, 538 aa, Artificial Sequence
  VP1__Norovirus_and/or_Norovirus-like__KR904213
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFFSLAPMGNGTGRRR

SEQ ID NO: 3665 - protein, 538 aa, Artificial Sequence
  VP1__Norovirus_and/or_Norovirus-like__AB933745
MKMASNHVNPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSIMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3666 - protein, 538 aa, Artificial Sequence
  VP1__Norovirus_and/or_Norovirus-like__KP096341
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWSNYDPTEEIPAPLGTPDFVGKIQGMLTQTTRTDGSTRGHKATVYIGGADFAPKLGRVQFETDTDHDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3667 - protein, 538 aa, Artificial Sequence
  VP1__Norovirus_and/or_Norovirus-like__KM114291
MKMASSDANPSDGSAANLVPEVNNEVMALEPVVGAAIAAPVAGQQNVIDPWIRNNFVPAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGATQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDRDFEANQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3668 - protein, 538 aa, Artificial Sequence
  VP1__Norovirus_and/or_Norovirus-like__KF060105
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNVCTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3669 - protein, 538 aa, Artificial Sequence
  VP1__Norovirus_and/or_Norovirus-like__KF060081
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3670 - protein, 538 aa, Artificial Sequence
  VP1__Norovirus_and/or_Norovirus-like__KF059999
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQETAPAQSDVALLRFVNPDTGRVLFECKLHKSCYVTVAHTGQHDLVIPPNGYFRFDSWVNQFYTLAPMGNGTGRRR

SEQ ID NO: 3671 - protein, 538 aa, Artificial Sequence
  VP1__Norovirus_and/or_Norovirus-like__JX644036
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSNAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3672 - protein, 538 aa, Artificial Sequence
  VP1__Norovirus_and/or_Norovirus-like__JX459654
MKMASNDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSLDFDFIFLVPPTVESRTKPFSVPVLTVEEMTNSRFPIPLEKLFTGPSSAFVVQPQNGRCTTDGVLLGTTQLSPVNICTFRGDVIHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3673 - protein, 538 aa, Artificial Sequence
  VP1__Norovirus_and/or_Norovirus-like__JN400621
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVMFECKLHKSGYVTVAHTGQHDLVIPPNGYFRFDSWVNQFYTLAPMGNGTGRRR

SEQ ID NO: 3674 - protein, 538 aa, Artificial Sequence
  VP1__Norovirus_and/or_Norovirus-like__AB541260
MKMASNDANPSDGSAANLVPEVNNEVMALEPVVGAAIAAPVAAQQNVIDPWIRNNFVQAPGGEFTVSPRNAPSEILWSAPLGPDLNPYLSHFARMYNCYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGEDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIAGSRNYTMNLASLNWNNYDPTEEIPAPLGTPDFVGKIQGVLTQTTKGDGSTRGHKATVYTGSAPFTPKLGSVQFSTDTENDFETHQNTKFTPVGVIQDGGTTHRNEPQQWVLPSYSGRNVPNVHLAPAVAPTFPGEQLLFFRSTMPGCSGYPNMDLDCLLPQEWVQHFYQEAAPAQSDVALLRFVNPDTGRVLFECKLHKSGYVTVAHTGQHDLVIPPNGYFRFDSWVNQFYTLAPMGNGTGRRR

SEQ ID NO: 3675 - protein, 538 aa, Artificial Sequence
  VP1__Norovirus_and/or_Norovirus-like__KX514341
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTQSGNTKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQSGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3676 - protein, 538 aa, Artificial Sequence
  VP1__Norovirus_and/or_Norovirus-like__KX514253
MKMASNDANPSDGSTANLVPEVNNEVMALEPVVGAAIAAPVAGQQNVIDPWIRNNFVQAPGGEFTVSPRNAPGEILWSAPLGPGLNPYLSHLARMYNGYAGGFEVQVILAGNAFTAGKIIFAAVPPNFPTEGLNPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSNLVVQPQNGRCMIDGVLLGTTQLSPVNICTFRGDVTHLRDSTIYTMNLASPNWNNYDPTEEIPAPLGTPDFVGKIQGVLTQTTKGEGSTRGHRATVYVGSADYTPKLGKVQFETNTTNDLYAHQNTKFTPVGVVQGGESAHRSEPQQWVLPGYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3677 - protein, 538 aa, Artificial Sequence
  VP1__Norovirus_and/or_Norovirus-like__KX514195
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNSYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRTKPFSVPILTVGEMTNSRFPINLERLFTGPSSTLVVQPQNGRCMIDGVLLGTTQLSPVNICTFRGDVTHSRDSTIYTMNLASPNWNNYDPTEEIPAPLGTPDFVGKIQGVLTQTTKGEGSTRGHRATVYVGSANYTPKLGKVQFETNTTNDLYAHQNTRFTPVGVVQGGESAHRSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3678 - protein, 538 aa, Artificial Sequence
  VP1__Norovirus_and/or_Norovirus-like__KX354016
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGGVTHIPGSHNYTMNLASQNWSSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3679 - protein, 538 aa, Artificial Sequence
  VP1__Norovirus_and/or_Norovirus-like__KM245073
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHLIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3680 - protein, 538 aa, Artificial Sequence
  VP1__Norovirus_and/or_Norovirus-like__LN854567
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSDFVVQPQNGRCTTDGVLLGTTQLSPVNICTFRGDVTHTTGSRNYTMNLASQNWNNYDPTEETPAPLGTPDFVGKIRGMLTQTTRADGSTRGHKATVYTGSADFAPKLGRVQFETDTDNDFDANQNTKFTPVGVIQDGTTTHRNEPRQWVLPSYSGRNTHNVHLAPAVAPTFPGEQLLFFRSTMPGCSGYPNMDLDCLLPQEWVQFFYQEAAPAQSDVALLRFVNPDTGRVLFECKLHKSGYVTVAHTGPHDLVIPPNGYFRFDSWVNQFYTLAPMGNGTGRRR

SEQ ID NO: 3681 - protein, 538 aa, Artificial Sequence
  VP1__Norovirus_and/or_Norovirus-like__JN400619
MKMASSDANPSDGSTANLVPEVNNEVMALEPVVGAAIAAPVAGQQNVIDPWIRNNFVQAPCGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3682 - protein, 538 aa, Artificial Sequence
  VP1__Norovirus_and/or_Norovirus-like__KF060052
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFVTDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3683 - protein, 538 aa, Artificial Sequence
  VP1__Norovirus_and/or_Norovirus-like__KF060014
MKMASSDANPSDGSTANLVPEVSNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANSAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEEIPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3684 - protein, 538 aa, Artificial Sequence
  VP1__Norovirus_and/or_Norovirus-like__KC517375
MKMASSDANPSDGSAANLVPEVNNEVMALEPVAGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYAPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3685 - protein, 538 aa, Artificial Sequence
  VP1__Norovirus_and/or_Norovirus-like__JX644039
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHISGSRNYTMNLASQNWTSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3686 - protein, 538 aa, Artificial Sequence
  VP1__Norovirus_and/or_Norovirus-like__JX644031
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWSSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3687 - protein, 538 aa, Artificial Sequence
  VP1__Norovirus_and/or_Norovirus-like__HM191773
MKMASSDANPSDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTAEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3688 - protein, 538 aa, Artificial Sequence
  VP1__Norovirus_and/or_Norovirus-like__AB504309
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGVLTQTTRGDGSTRGHKATVSTGSVDFTPKLGSVQFATDTDNDFETGQNTRFTPVGVIQDGSSAHRNEPQQWVLPDYSGRTVHNVHLAPAVAPTFPGEQLLFFRFTMPGCSGYPNMDLDCLLPQEWVQHFYQEAAPAQSDVALLRFVNPDTGRVLFECKLHKTGYVTVAHTGQHDLVIPPNGYFRFDSWVNQFYTLAPMGNGAGRRR

SEQ ID NO: 3689 - protein, 538 aa, Artificial Sequence
  VP1__Norovirus_and/or_Norovirus-like__KX514216
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHLRDSPIYTMNLASPNWNNYDSTEEIPAPLGTPDFVGKIQGVLTQTTKGEGSTRGHRATVYVGSANYTPKLGKVQFETNTTNDLYAHQNTKFTPVGVVQGGESAHRSEPQQWVLPGYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3690 - protein, 538 aa, Artificial Sequence
  VP1__Norovirus_and/or_Norovirus-like__KX514212
MKMASNDANPSDGSAANLVPEVNNEVMALEPVVGAAIAAPVAGQQNVIDPWIRNNFVQAPGGEFTVSPRNAPGEILWSAPLGPELNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVQEMTNSRFPATLDKLFTGPSSNLVVQPQNGRCMIDGVLLGTTQLSPVNICTFRGDVTHPRDSPIYTMNLASPNWNNYDPTEEIPAPLGTPDFVGKIQGVLTQTTKGEGSTRGHRATVYVGSANYTPKLGKVQFETNTTNDLYAHQNTKFTPVGVVQGGESAHRSEPQQWVLPGYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3691 - protein, 538 aa, Artificial Sequence
  VP1__Norovirus_and/or_Norovirus-like__KX354138
MKMASSDANPSDGSAANLVPEANNEVMALEPVVGAAIAAPVAGQQNVIDPWIRNNFVQAPGGEFTISPRNAPGEILWSAPLGPDLNPYLSHLARMYNGYAGGFEVQVILAGNAFTAGKVIFAAVPPNFPTAGLSPSQVTMFPSIVVDVRQLEPVLIPLPDVRNNFYHYNQSNDPTITLIAMLYTPLRANNAGDDVFTVSCRVLTRPSPDFDFIFLVPPTVESRTKPFSVPVLTVEEMTNSRFPIPLERLFTGPSSAFVVQPQNGRCTTDGVLLGTTQLSPVNICTFRGDITHITGSHNYTMNLASQNWNNYDPTEEIPAPLGTPDFVGKIQGVLTQTTRGDGSTRGHKATVYTGSADFSPKLGRVQFETDTNHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYITVAHTGQHDLVIPPNGYFRFDSWVNQFYTLAPMGNGTGRRR

SEQ ID NO: 3692 - protein, 538 aa, Artificial Sequence
  VP1__Norovirus_and/or_Norovirus-like__AB933747
MKMASSDANPFDGSTANLVPEVNNEVMALEPVVGAAIAAPVAGQQNVIDPWIRNNFVQAPGGEFTVSPRNAPGEILWSAPLGPDLNPYLSHLSRMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3693 - protein, 538 aa, Artificial Sequence
  VP1__Norovirus_and/or_Norovirus-like__KJ955493
MKMASSDANPSDGSAANLVPEVNNEVMALEPFVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDLTEEIPAPLGTPDFVGKIQGVLTQTTRTDGSTRGHKATVYTGSADFAPKLGRVQFETDTDHDFEANQNTKFTPVGVIQDGGTTHRSEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3694 - protein, 538 aa, Artificial Sequence
  VP1__Norovirus_and/or_Norovirus-like__KJ678153
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYIGSADFAPKLGRVQFETDTDHDFETNQNTKFTPVGVIQDGSTTHRNEPQQWVLPSYSGRNTPNVHLAPAVAPTFPGEQLLFFRSTLPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3695 - protein, 538 aa, Artificial Sequence
  VP1__Norovirus_and/or_Norovirus-like__KC456071
MKMASSDANPPDGSAANLVPKVNNEVMALEPVVGAAIAAPVAGQQNVIDPWIKNNFVQAPGGEFTVSPKNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRDTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3696 - protein, 538 aa, Artificial Sequence
  VP1__Norovirus_and/or_Norovirus-like__KC175384
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWDSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3697 - protein, 538 aa, Artificial Sequence
  VP1__Norovirus_and/or_Norovirus-like__JQ613561
MKMASSDANPSDGSTANLVPEVNTEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDAALLRFVNPDTGRVLFECKLHKSGYVTVAHTGQHDLVIPPNGYFRFDSWVNQFYTLAPMGNGTGRRR

SEQ ID NO: 3698 - protein, 538 aa, Artificial Sequence
  VP1__Norovirus_and/or_Norovirus-like__KJ678145
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPTPLEKLFTGPSSAFVVQPQNGRCTTDGVLLGTTQLSPVNICTFRGDVTHITGSRNYTMNLASQNWSNYDPTEEIPAPLGTPDFVGKIQGVLTQTTRTDGSTRGHKATVYTGSADFAPKLGRVQFETDTDHDFETNQNTKFTPVGVIQDGSTTHRNEPQQWVLPSYSGRNTPNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFESWVNQFYTLAPMGNGTGRRR

SEQ ID NO: 3699 - protein, 538 aa, Artificial Sequence
  VP1__Norovirus_and/or_Norovirus-like__KF060116
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNICTFRGDVTHIPGSHNYTMNLASQNWNSYDPTEETPAPLGTPDFVGKIQGVLTQTTSTNGSTRGHKATVYTGSADFSPKLGRVQFATDTNNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3700 - protein, 538 aa, Artificial Sequence
  VP1__Norovirus_and/or_Norovirus-like__KC517362
MKMASSDANPSDGSAANLVPEVNNEVIALEPVVGAAIAAPVAGQQNVIDPWIRNNFVQAPGGEFTVSPRNAPGEILWSAPLGPDLNPYLSHLARMYNGYAGGFEVQVILAGNAFTAGKVIFAAVPPNFPTEGLSPSQVTMFPHIVVDVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDIAHITGSRNYTMNLASQNWNNYDPTEEIPAPLGTPDFVGKIQGVLTQTTRTDGSTRGHKATVYTGSADFAPKLGRVQFETDTDHDFEANQNTKFTPVGVIQDGGTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECNLHKSGYVTVAHTGQHDLVIPPNGYFRFDSWVNQFYTLAPMGNGTGRRR

SEQ ID NO: 3701 - protein, 538 aa, Artificial Sequence
  VP1__Norovirus_and/or_Norovirus-like__JX644038
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPILTVEEMTNSRFPIPLEKLFTGPSSAFVVQPQNGRCTTDGVLLGTTQLSPVNVCTFRGDVTHISGSRNYTMNLASQNWTSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3702 - protein, 538 aa, Artificial Sequence
  VP1__Norovirus_and/or_Norovirus-like__AB504313
MKMASNDASPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFTVPILTVEEMTNSRFPIPLEKLFTGPSSAFVVQPQNGRCTTDGVLLGTTQLSPVNICTFRGDVTHIPGTRTYRMNLASQNWNNYDPTEEIPAPLGTPDFVGKIQGMLTQTTRGDGLTRGHKATVSTGSVDFTPKLGSVQFATDTDNDFETGQNTRFTPVGVIQDGSSAHRNEPQQWVLPDYSGRTVHNVHLAPAVAPTFPGEQLLFFRSTMPGCSGYPNMDLDCLLPQEWVQHFYQEAAPAQSDVALLRFVDPDTGRVLFECKLHKTGYVTVAHTGQHDLVIPPNGYFRFDSWVNQFYTLAPMGNGAGRRR

SEQ ID NO: 3703 - protein, 538 aa, Artificial Sequence
  VP1__Norovirus_and/or_Norovirus-like__KX514361
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHPRDSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGKDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3704 - protein, 538 aa, Artificial Sequence
  VP1__Norovirus_and/or_Norovirus-like__KX514336
MKMASNDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRSKPFSVPVLTVEEMTNSRFPATLDKLFTGPSSTFVVQPQNGRCMIDGVLLGTTQLSPVNICTFRGDVTHSGNSKIYTMNLASPNWNNYDPTEEIPAPLGTPDFVGKIQGMLTQTTKGEGSTRGHRATVYVGSANYAPKLGRVQFETDTTDDLDAHQNTKFTPVGVVQGGESPKGSEPQQWVLPSYSGRDTPNVHLAPAVAPTFPGEQLLFFRSTIPGCGGHPNMNLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3705 - protein, 538 aa, Artificial Sequence
  VP1__Norovirus_and/or_Norovirus-like__KX514203
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPTFPTEGLSPSQVTMFPHIIVDVRQLEPVLIPLPDVRNNFYHYNQSNDSTIKLIAMLYTPLRANNPGDDVFTVSCRVLTRPSPDFDFIFLVPPTVESRSKPFSVPVLTVQEMTNSRFPATLDKLFTGPSSTLVVQPQNGRCMIDGVLLGTTQLSPVNICTFRGDVTHSRDSTIYTMNLASPNWNNYDPTEEIPAPLGTPDFVGKIQGVLTQTTKGEGSTRGHRATVYVGSANYTPKLGKVQFETNTTNDLYAHQNTRFTPVGVVQGGESAHRSEPQQWVLPSYSGRDTPNVHLAPAVAPTFPGEQLLFFRSTIPGCGGHPNMDLDCLLPQEWVQHFYQEAAPAQSDVALLRFVNPDTSRVLFECKLHKSGYVTVAHTGQHDLVIPPNGYFRFDSWVNQFYTLAPMGNGTGRKR

SEQ ID NO: 3706 - protein, 538 aa, Artificial Sequence
  VP1__Norovirus_and/or_Norovirus-like__KP784693
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTEGVLLGTTQLSPVNICTFRGDVTHISGSRNYTMNLASQNWNSYDPTEEIPAPLGTPDFVGKIQGVLTQTTRTDGSTRGHKATVYTGSADFSPKLGRVQFATDTDNDFVTNQNTKFTPVGVIQDGSTTPRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGAGRRR

SEQ ID NO: 3707 - protein, 538 aa, Artificial Sequence
  VP1__Norovirus_and/or_Norovirus-like__AB933734
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESETKPFFFPVLTVEEMTNSRFPIPLEKLFTGPSSAFVVQPQNGRCTTDGVLLGTTQLSPVNICTFRGDVTHIPGSRNYTMNLASQNWNSYDPTEEIPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

SEQ ID NO: 3708 - protein, 538 aa, Artificial Sequence
  VP1__Norovirus_and/or_Norovirus-like__KF060041
MKMASSDANPSDGSAANLVPEVNNEVMALEPVVGAAIAAPVAGQQNVIDPWIRNNFVQAPGGEFTVSPRNAPGEILWSAPLGPDLNPYLSHLARMYNGYAGGFGVQVILAGNAFTAGKVIFAAVPPNFPTEGLSPSQVTMFPHIVVNVRQLEPVLIPLPDVRNNFYHYNQSNDPTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHITGSRNYTMNLASQNWNNYDPTEETPAPLGTPDFVGKIQGVLTQTTRTDGSTRGHKATVYTGSADFAPKLGRVQFETDTDHDFEANQNTKFTPVGVIQDGSTTHRNEPQQWVLPSYSGRNTHNVHLAPAVAPTFPGEQLLFFRSTMPGCSGYPNMDLDCLLPQEWVQYFYQEAAPAQSDVALLRFVNPDTGRVLFECKLHKSGYVTVALTGQHDLVIPPNGYFRFDSWVNQFYTLAPMGNGTGRRR

SEQ ID NO: 3709 - protein, 538 aa, Artificial Sequence
  VP1__Norovirus_and/or_Norovirus-like__JX989074
MKMASSDANPSDGSTANLVPEVNNEVMALEPVVGAAIAAPVAGQQNVIDPWIRNNFVQAPGGEFTVSPRNAPGEILWSAPLGPDLNPYLSHLARMYNGYAGGFEVQVILAGNAFTAGKIIFAAVPPNFPTEGLSPSQVTMFPHIIVDVRQLEPVLIPLPDVRNNFYHYNQSNDSTIKLIAMLYTPLRANNAGDDVFTVSCRVLTRPSPDFDFIFLVPPTVESRTKPFSVPVLTVEEMTNSRFPIPLEKLFTGPSSAFVVQPQNGRCTTDGVLLGTTQLSPVNICTFRGDVTHIPGSRNYTMNLASQNWNSYDPTEETPAPLGTPDFVGKIQGVLTQTTRTNGSTRGHKATVYTGSADFSPKLGRVQFATDTDNDFETNQNTKFTPVGVIQDGSTTPRNEPQQWVLPSYSGRNIHNVHLAPAVAPTFPGEQLLFFRSTMPGCSGYPNMDLDCLLPQEWVQYFYQEAAPAQSDVALLRFVNPDTGRVLFECKLHKSGYVTVAHTGQHDLVIPPNGYFRFDSWVNQFYTLAPMGNGTGRRR

(The sequence listing continues in the following parts.)

The invention claimed is:

1. Artificial nucleic acid molecule comprising at least one coding region encoding a Norovirus VP1 polypeptide, said coding region having at least 90% identity to a sequence of SEQ ID NOs: 39713-39746, wherein the artificial nucleic acid molecule comprises at least one heterologous 5' and/or 3' untranslated region (UTR).

2. The artificial nucleic acid molecule of claim 1, wherein the artificial nucleic acid is monocistronic, bicistronic or multicistronic.

3. The artificial nucleic acid molecule of claim 1, wherein the artificial nucleic acid is an mRNA.

4. The artificial nucleic acid molecule of claim 3, wherein the artificial nucleic acid comprises a 5'-cap structure.

5. The artificial nucleic acid molecule of claim 1, wherein the G/C content of the coding region of the mRNA sequence is increased compared to the G/C content of the corresponding coding sequence of the wild type mRNA, or wherein the C content of the coding region of the mRNA sequence is increased compared to the C content of the corresponding coding sequence of the wild type mRNA, or wherein the codon usage in the coding region of the mRNA sequence is adapted to the human codon usage, or wherein the codon adaptation index (CAI) is increased or maximised in the coding region of the mRNA sequence, wherein the encoded amino acid sequence of the mRNA sequence is preferably not being modified compared to the encoded amino acid sequence of the wild type mRNA.

6. The artificial nucleic acid molecule of claim 1, wherein the artificial nucleic acid comprises at least one histone stem-loop.

7. The artificial nucleic acid molecule of claim 1, wherein the 3'-UTR comprises at least one heterologous 3'-UTR element.

8. The artificial nucleic acid molecule of claim 1, wherein the 3'-UTR comprises a poly(A) sequence and/or a poly(C) sequence.

9. The artificial nucleic acid molecule of claim 1, wherein the 5'-UTR comprises at least one heterologous 5'-UTR element.

10. The artificial nucleic acid molecule of claim 1, comprising the following elements:

a) optionally a 5'-cap structure, b) the at least one coding region, c) a poly(A) tail comprising 10 to 200 adenosine nucleotides, d) optionally a poly(C) tail comprising 10 to 200 cytosine nucleotides, and e) optionally a histone stem-loop.

11. The artificial nucleic acid molecule of claim 10, comprising a 3'-UTR element comprising a nucleic acid sequence, which is derived from an α-globin gene.

12. The artificial nucleic acid molecule of claim 1 said coding region having at least 95% identity to a sequence of SEQ ID NOs: 39713-39746.

13. The artificial nucleic acid molecule of claim 10, comprising a 5'-UTR element, which comprises or consists of a nucleic acid sequence, which is derived from the 5'-UTR of a TOP gene.

14. The artificial nucleic acid molecule of claim 1, wherein the coding region comprises a chemically modified nucleotide.

15. A method of treating or preventing a Norovirus infection, wherein the method comprises administering to a subject in need thereof the artificial nucleic acid according to claim 1.

16. The artificial nucleic acid molecule of claim 1, said coding region having at least 90% identity to a sequence of SEQ ID NOs: 39743.

* * * * *